United States Patent 7,745,391 (HUMAN THROMBOSPONDIN POLYPEPTIDE) - sequence listing, part 172

SEQ ID NO: 432534 - DNA, 3774 bp, Homo sapiens
cttggatcagcggactctgggggaagccagccactcaagcagtcctatgaaggggtccgtgcagtgaggaaatgaggcctctgcaacagctatgcaagtgaattatcttggtaacaggtctttcagcctccgtcaagccttcagatgactgcggcctcaagtgacatcttgactcaccagctaaactgctcccaaattgctggaccacaaaaactgtggagtacatcctgctgcttcaagggtagaagactcctcactgctttccttcatgagatttcaaagggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432535 - DNA, 3770 bp, Homo sapiens
cttggatcagcggactctgggggaagccagccactcaagcagtcctatgaaggggtccgtgcagtgaggaaatgaggcctctgcaacagctatgcaagtgaattatcttggtaacaggtctttcagcctccgtcaagccttcagatgactgcggcctcaagtgacatcttgactcaccagctaaactgctcccaaattgctggaccacaaaaactaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432536 - DNA, 3575 bp, Homo sapiens
accgttaatgtgtgtcttctcttccccagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432537 - DNA, 4079 bp, Homo sapiens
cttggatcagcggactctgggggaagccagccactcaagcagtcctatgaaggggtccgtgcagtgaggaaatgaggcctctgcaacagctatgcaagtgaattatcttggtaacaggtctttcagcctccgtcaagccttcagatgactgcggcctcaagtgacatcttgactcaccagctaaactgctcccaaattgctggaccacaaaaactgtggagtacatcctgctgcttcaagggtagaagactcctcactgctttccttcatgagatttcaaaggagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaagagctggcttttaagaagctttctgtctgcctgttcagtgtggccctcactggaggaatgagaagtgcctacacacttagactgcagggtctgagaattttgagggtcatccatgtaggcagctcagcaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432538 - DNA, 4000 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagtggagtacatcctgctgcttcaagggtagaagactcctcactgctttccttcatgagatttcaaaggaagtgttggttttttttttgcctggttcaagtattgaccaagaagatgacagtgatgtggtctcttagagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432539 - DNA, 3959 bp, Homo sapiens
ggttgcagtgagctgagatggtgccactgcactccagcctgggtgacagagtaagactccgtctcaaaaaaaaaaaaaaaaaaaaaatttacagcttaattaaagatgaaaataaaacaaaagtaattaatgtaacaaagattttgttaattgttaaagctttatagagctttgtaggtttggggaagagaacttgccagattgtgataatctcggaagaccttttaggtaattgtagcgtggaccttctgtatgtctaaaatggtaaacggtgtgccttatcttttataggagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432540 - DNA, 4600 bp, Homo sapiens
atagcctcccaaagtgctgggattacaggtgtgagccacggcaccaggcctcatcccattacattctaaagattgtgtcaaaatgagttatgcttcttgtgaggtgatgggaccgttatatctctccagtgtctgtggtacaacagactaaaagatgaatatatttaatttcttaatgtttcttttgctaattttccttagctagcaatatatgtgttagctttagtgtctttttaggttcagattatttttggtagaccttaaaaaatgagaagataaaggatatccgaaagaagccttaaggtagatcctttacttggaagtatcaggctcttccacctgactccactcataataaaaaatgaaaacaaaagtggttgacgtagcaaagattttaacttttaaagcttgatagagctttgcaggtttaggaagataacttcccagtcttcagattgggatggtgagactgtgtggccccacctccatgcaggccatgcagaacacaggactgtagagaaacagaggctcattctcagttccaacaggaggaagagtgcccactgggcagccagtcctgttagggcaaggagcagcccttctggagacatggcagatcttaacgtttcagtgcatatggatgggggagggtgttctggggctggtggaacgtagagggcattcatggtggtgaaagtgggatgtaggagagggtttgggtgatgatggataactgggttcactgtgtgctaactgagctgaacagagtatgaggcgttggcctacattgtctccctggaaagactgctgtcacaggttctcttgctggcattgtgatgcagggctgcgtgaagccctccttacagcgggaggtgggctctgttggagtgggccctgtgcctctgctgtctcctactgctaacagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcagggcaccccgatccgctcgccactgaccacgtcgtacacacagtgcccagcattatacggagaccagccttggcatgaactcacccttgctcacatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432541 - DNA, 3430 bp, Homo sapiens
taattcaaattaatttttttcattttttgagaggtataacttgttttgttttgttgttgttgttgttgttttctttgagacagagtctctgttgcccaggttggaggctgtcattgccagtgctttgcaagtcaggtaaccatgacgggaggcagacaaaagctgtagctttttcttttttccctttgcagcataggcttatctcttacagttcatgttgtcttggctgctaagagcttcatatgtgagacccaaacacacagtgacatacacctgctcgggcacctgtttcatttttggcattgaggagctgggatgttgttactttgtatatagacagcagcaaataaaacttgcaagaggagcttctcctttaaggccaagagaatttcgaacttcagttctcttagagtttgaatggtgaagacttactggatttaagctatatccctctgagggcaggacctggtagtagacctagtacgtgatatcagtcagcactgctttccctttgattttatcgtaagccttaccacaaagtggatctgtctgggtttgggattttaatagaatatggcatgagaaagcagagtttattgctatttgccatgctgctagtcgttatactatcgtggtgctttaaaaagaagaatactgacctgtggtctttccttaacatagataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432542 - DNA, 1698 bp, Homo sapiens
  misc_feature (40)..(40): n is a, c, g, or t
taagccagacgttccttctccgaggcccttagacacggtncttgtgctctggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432543 - DNA, 2637 bp, Homo sapiens
atagcctcccaaagtgctgggattacaggtgtgagccacggcaccaggcctcatcccattacattctaaagattgtgtcaaaatgagttatgcttcttgtgaggtgatgggaccgttatatctctccagtgtctgtggtacaacagactaaaagatgaatatatttaatttcttaatgtttcttttgctaattttccttagctagcaatatatgtgttagctttagtgtctttttaggttcagattatttttggtagaccttaaaaaatgagaagataaaggatatccgaaagaagccttaaggtagatcctttacttggaagtatcaggctcttccacctgactccactcataataaaaaatgaaaacaaaagtggttgacgtagcaaagattttaacttttaaagcttgatagagctttgcaggtttaggaagataacttcccagtcttcagattgggatggtgagactgtgtggccccacctccatgcaggccatgcagaacacaggactgtagagaaacagaggctcattctcagttccaacaggaggaagagtgcccactgggcagccagtcctgttagggcaaggagcagcccttctggagacatggcagatcttaacgtttcagtgcatatggatgggggagggtgttctggggctggtggaacgtagagggcattcatggtggtgaaagtgggatgtaggagagggtttgggtgatgatggataactgggttcactgtgtgctaactgagctgaacagagtatgaggcgttggcctacattgtctccctggaaagactgctgtcacaggttctcttgctggcattgtgatgcagggctgcgtgaagccctccttacagcgggaggtgggctctgttggagtgggccctgtgcctctgctgtctcctactgctaacagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432544 - DNA, 1116 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtgagacttttgacggcagcccctaggccctagtacctaattggttaggctttcaacatgaatgctgtttacaaatatgtatatgtattacatatgtatcagtgcataatgtatatatgttatgtatgttacatatgtatcagtgcataacattttgaactcttattaagtcagtatttaatgatattttgtgttgtgaagggaacaacatgtaattgtcaggcatacgttttttgcctgtcgttttttttttttaaggtatgtgacatggtacaattacattgtttttgttcagtatctactataaaacatccacttagttcattaggaagtaatttagaagaaataacttactgggtttatttacta

SEQ ID NO: 432545 - DNA, 794 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaaaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcagggaaaagctcgataaaactaagcagatacaatggctattatgaatttacagtttgagatttcagattggtgataaagaggcaagagctgtagctggttttttatattttgaactgtgctgagtagttcttaggaattagattagtcctgaaatgttatgtcagctgagaatttcggtttctaggtgacagtactgcagtaggaacaggactggctctccctttagaacaaaaggctttcagtgggaattcgtagtggcttctttg

SEQ ID NO: 432546 - DNA, 441 bp, Homo sapiens
agatccaccaggcttacttgaaatatgccttggtcatatgtacatgtaatgattattgcttagtggggaaaagctggtgttctttgttgttgctgtacaagtgttgagcaggtggttgtccgcttcactgaaaagaacctgactggaccaacaatggggaatgcagatttggagctttcttgacattggcctgttttttcccctgtaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtaca

SEQ ID NO: 432547 - DNA, 3522 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432548 - DNA, 1941 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaaggtaagtgtttcttcccatcaactgtctgccatcgctgactccagggacgtgcctttaacaaatgctgtgaaggaattggctggaagtggccaagccctgtgtgtgtgtactgatcagttttattacttttatactcctgaagaagtaatgtgatttaaataaattttctatgccattaggctatttcttgctctctgcataccaaatcttatttctgaccagttttcatttttaatatatttagtcagcgacatgatgggccgagcctgata

SEQ ID NO: 432549 - DNA, 820 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacagccttcaagggttagattacttacacatgagtacggctccacagcagaaacctataggaaaaatatctaaaaaa

SEQ ID NO: 432550 - DNA, 3491 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatg

SEQ ID NO: 432551 - DNA, 698 bp, Homo sapiens
agactgcctgagttcaaatcccagttctgctgcttcctggctgtgtgaccctgggcaaatcacttagcctgtctgggcttcagatttctcatctgtacaatgaagataataaaatacctatctttatggttgtagtaaggattaaatgaattgaaataaagcttttagattaatacttgatatgctacataggtgtcagccattgttaatcattgttgtcattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggccatgggctgacaggcctgggtttggctgttccctccaggggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagcagcaccacgaattcgccgagcagcaccacgaattcgccg

SEQ ID NO: 432552 - DNA, 831 bp, Homo sapiens
ggccggagcgcggggaggtggcgccgctggcgggcaggtctccttgggggtccgtggtccaggccaccctgcggctgttgcaaccatccccgcgtgggctgtgctcgggggcggtggtcttcaggctggggctgagaccccggctcggggctgcttgctccggatcgattttcccttttcttccgcccctggccacctctccatatggcgtgcggtggcagcgccgcttcctgggccgccctgggttcaacctgagcggcgggcctcccgggaccctgctgccccttaggcggaggggagagcgccggagagatcggcggccgcctccggatctgcctggagaaggaccagctggagtgcggctggggacgagaaaactggggggcgtacgcgggctcccccgcgggccctgtgggggcggggtcaggacagcagaccgttttattgcttaactcagtgggttggaagctgtaaccccgacatgggcttgcgctacgtcctgcccctccgacccccgggaaaggtgggcagctcggttcgagttgaggggctgcagaacgagggtcagtcttaggggatatttggggccagtcactggggatccctacttagccacggagctgcatcccaggcaggcgcggtgtgccgggtgcgcgccccgccacgggagctgggctcggagctggcgatgggacccgggcacagtggccagtggcaggaagaggtcagaaaccactcgtggtggtggggggagggcgcctcaaccctaccgctgcttcctgcctgcgcggtgagcctgtgcccccaggcggccacgtaccctgaataccc

SEQ ID NO: 432553 - DNA, 318 bp, Homo sapiens
ggtggggcaactgtgttgagaggctctgctgagtaggtgtccacctcccaccccctggcaccattaaatggcttgtccaatgagggtgacaacaccagccccctgaccacttgcccttcttgtctctgcccagacattcacggcatggtgtaactcccacctccggaaggcggggacacagatcgagaacaaaggatgttaagaccagtaaaccagagactagggccccgtcctcagccctcactctcagttgtataactcaagcttggtatcttcagatcgtatttatgagtagagcccagactgctcagcattcct

SEQ ID NO: 432554 - DNA, 7310 bp, Homo sapiens
  misc_feature (4759)..(4759): n is a, c, g, or t
  misc_feature (5219)..(5219): n is a, c, g, or t
  misc_feature (5764)..(5764): n is a, c, g, or t
  misc_feature (6301)..(6301): n is a, c, g, or t
  misc_feature (6554)..(6554): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432555 - DNA, 3683 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatg

SEQ ID NO: 432556 - DNA, 7256 bp, Homo sapiens
  misc_feature (4705)..(4705): n is a, c, g, or t
  misc_feature (5165)..(5165): n is a, c, g, or t
  misc_feature (5710)..(5710): n is a, c, g, or t
  misc_feature (6247)..(6247): n is a, c, g, or t
  misc_feature (6500)..(6500): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaagaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432557 - DNA, 4018 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatgaaaaaaaaaaaaaaacaaaaaaaaaaaaaaaaaaaaaacaaaaaaaaaaaaaaaacaaacaaaacaaaaaaaaaaaaaaaacaaacgaaagaaaacgagaaaacgagcaagtacacgaagcagcaaagcaaaaaagcaccagcagcagcaaagacgacccaccagcagccagccaccaaaacacagcatagggggaaacacacaaagctgacaaaaagcaacgacgacgagacaacatgagacaagaccaagaaaacacacaaaccccacaccagatccacacatagcacggagacacacggaggaataacacaaagccagcacatacagcaacaacaacacgaaaaaacaaaaaacgagtagaagaccaccgagacaagacaaggcagaatatatcagacgccagaaaaacagacagaacacggcggcagacaagaaggcacaacccagaagaacaccaccacacacgaccacagaatacgaccacacagcaaagacaaaacgacagagaacagaagacagagcgg

SEQ ID NO: 432558 - DNA, 3957 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaccaggtcatggcttccttcacagatcctggactggggaacaaagtaactacatttacacatgggatcgagctgcgccgccagctgccgacgccgaccaggctgagtactgcactcgcgcggatggaccgctataccgggcccgactccgtgccaggtgctctggactacgtgtccttctccacggcgctgtgacggcgcagagtgacctctagtccacccggccggcgccctcgtcttgtgcgcgtgccctgccgttgctacctcctgccgatagccacagtatccatgcctaggaattcggacacaggctcgcatgctccaacgcgggtgacacttgtggcccaacatggcactcaatgctcaacagacaacatcgttggagctttccaaagtaaccaaagcctgcaggaagggacagcggcatatacgcgtccaagaacagccaccagagccgcccccgtgagcaccgcacacacacgcatgataaactcgagcgacgcaaccgtacactgcgccacagtacacactgggcacccacacccagtacggtgcgcacgcgcgaccaatctgccgccacaccacaacaaagccactgaccccgcccccccacccccccccgacacaaacacgacttgtcaacacacacccacgcatcatggtcggcgaaaccagccacgcccaatacaccacaccgacacacagccacccccgcgcggtcaccaacacggcgcagaacggtgacgacacaaccataacccccacgacgacacgaccagccacgtcaacccgacgaccaaacaagacgacgcgcaccagtgcacacgac

SEQ ID NO: 432559 - DNA, 7127 bp, Homo sapiens
  misc_feature (4576)..(4576): n is a, c, g, or t
  misc_feature (5036)..(5036): n is a, c, g, or t
  misc_feature (5581)..(5581): n is a, c, g, or t
  misc_feature (6118)..(6118): n is a, c, g, or t
  misc_feature (6371)..(6371): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432560 - DNA, 6679 bp, Homo sapiens
  misc_feature (4128)..(4128): n is a, c, g, or t
  misc_feature (4588)..(4588): n is a, c, g, or t
  misc_feature (5133)..(5133): n is a, c, g, or t
  misc_feature (5670)..(5670): n is a, c, g, or t
  misc_feature (5923)..(5923): n is a, c, g, or t
aacaacatgtgtatgagtcagtatcccgcttgtaatttcagtgccgggacgagagctttagtcgttaagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432561 - DNA, 7127 bp, Homo sapiens
  misc_feature (4576)..(4576): n is a, c, g, or t
  misc_feature (5036)..(5036): n is a, c, g, or t
  misc_feature (5581)..(5581): n is a, c, g, or t
  misc_feature (6118)..(6118): n is a, c, g, or t
  misc_feature (6371)..(6371): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccaggtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432562 - DNA, 7017 bp, Homo sapiens
  misc_feature (309)..(309): n is a, c, g, or t
  misc_feature (4466)..(4466): n is a, c, g, or t
  misc_feature (4926)..(4926): n is a, c, g, or t
  misc_feature (5471)..(5471): n is a, c, g, or t
  misc_feature (6008)..(6008): n is a, c, g, or t
  misc_feature (6261)..(6261): n is a, c, g, or t
ggagatggactcagtagcggactgtctaggaaggtcactcatcatgggtgagactcatcgagagcacaggcgagcatcgggaggccaagcactgagagatgccacaatgatctccccaacgctccacagcgaacggcacgctggtaattctacgagtaacgcgggcatcaggacggtcaaacatggtgctcgcgatcggcaggcgcgacaggagatctcgatgcgatgtgcgagaatgctgcacacgtatgacaccgtgggccattgcagtctggcactgcattcactccttgtggcactttgcccccntctcacgtgcagcaatgtccagagtgcgcatgaggagaacgttctggcccaaggcaaggtggactggctccctgcagcgcctgtcgaggagtatacgtgacacgttcctcttttatcacatacatatgtgctccacaactaattcacacgcaaactctccctatgatacatcctgggaagggagtgggccgtgcggtaatgtgctggtgcgtttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432563 - DNA, 7295 bp, Homo sapiens
  misc_feature (4744)..(4744): n is a, c, g, or t
  misc_feature (5204)..(5204): n is a, c, g, or t
  misc_feature (5749)..(5749): n is a, c, g, or t
  misc_feature (6286)..(6286): n is a, c, g, or t
  misc_feature (6539)..(6539): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432564 - DNA, 6706 bp, Homo sapiens
  misc_feature (4155)..(4155): n is a, c, g, or t
  misc_feature (4615)..(4615): n is a, c, g, or t
  misc_feature (5160)..(5160): n is a, c, g, or t
  misc_feature (5697)..(5697): n is a, c, g, or t
  misc_feature (5950)..(5950): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432565 - DNA, 7229 bp, Homo sapiens
  misc_feature (4678)..(4678): n is a, c, g, or t
  misc_feature (5138)..(5138): n is a, c, g, or t
  misc_feature (5683)..(5683): n is a, c, g, or t
  misc_feature (6220)..(6220): n is a, c, g, or t
  misc_feature (6473)..(6473): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432566 - DNA, 7222 bp, Homo sapiens
  misc_feature (4671)..(4671): n is a, c, g, or t
  misc_feature (5131)..(5131): n is a, c, g, or t
  misc_feature (5676)..(5676): n is a, c, g, or t
  misc_feature (6213)..(6213): n is a, c, g, or t
  misc_feature (6466)..(6466): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggcaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432567 - DNA, 6274 bp, Homo sapiens
  misc_feature (3723)..(3723): n is a, c, g, or t
  misc_feature (4183)..(4183): n is a, c, g, or t
  misc_feature (4728)..(4728): n is a, c, g, or t
  misc_feature (5265)..(5265): n is a, c, g, or t
  misc_feature (5518)..(5518): n is a, c, g, or t
ttttattcatctttctgcaatggtgttgaacgacaaccatcgtagaatagatgtctgttatggtaaactacgagaagctgaacaggtaacctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432568 - DNA, 6324 bp, Homo sapiens
  misc_feature (3773)..(3773): n is a, c, g, or t
  misc_feature (4233)..(4233): n is a, c, g, or t
  misc_feature (4778)..(4778): n is a, c, g, or t
  misc_feature (5315)..(5315): n is a, c, g, or t
  misc_feature (5568)..(5568): n is a, c, g, or t
aagtgcaacctgtatttcatgcagtgatcgactctttgaggactccccggtcagaaactattcgttcttggtgacaagtccactcttcgtataggacgatcgattgttagtgttcattacttaggaacacccctaggggtctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432569 - DNA, 6651 bp, Homo sapiens
  misc_feature (4100)..(4100): n is a, c, g, or t
  misc_feature (4560)..(4560): n is a, c, g, or t
  misc_feature (5105)..(5105): n is a, c, g, or t
  misc_feature (5642)..(5642): n is a, c, g, or t
  misc_feature (5895)..(5895): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaaggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432570 - DNA, 7208 bp, Homo sapiens
  misc_feature (4657)..(4657): n is a, c, g, or t
  misc_feature (5117)..(5117): n is a, c, g, or t
  misc_feature (5662)..(5662): n is a, c, g, or t
  misc_feature (6199)..(6199): n is a, c, g, or t
  misc_feature (6452)..(6452): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432571 - DNA, 7424 bp, Homo sapiens
  misc_feature (4873)..(4873): n is a, c, g, or t
  misc_feature (5333)..(5333): n is a, c, g, or t
  misc_feature (5878)..(5878): n is a, c, g, or t
  misc_feature (6415)..(6415): n is a, c, g, or t
  misc_feature (6668)..(6668): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagttacaggagggaggcaaaatgcaaacggcacatgctgccttcacgccgccaggctttgcggctgtgtcgggccgcgccgctttacggctgctggactttgcggccttcctgaccactctctcctcgcagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432572 - DNA, 3241 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgcccacagatgtgaaatgaatgtaatctaatagaagcctaatcagcccaccatgttctccactgaaaaatcctctttctttggggtttttctttctttcttttttgattttgcactggacggtgacgtcagcctgtacaggctcccaggggtggcgtcaaatgctattgaaattgcgctgaatcgtatgctttttccttttgataaataaacaatgtaaaaatgtttcaaaaacctaataaaataaataaatacg

SEQ ID NO: 432573 - DNA, 3148 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggaccccctaacgcctcacctcgtagatactaagtacctgactcctacccctcgcaatcatggcaagccaacgccacttatccagtgaacca

SEQ ID NO: 432574 - DNA, 6757 bp, Homo sapiens
  misc_feature (4206)..(4206): n is a, c, g, or t
  misc_feature (4666)..(4666): n is a, c, g, or t
  misc_feature (5211)..(5211): n is a, c, g, or t
  misc_feature (5748)..(5748): n is a, c, g, or t
  misc_feature (6001)..(6001): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtatcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432575 - DNA, 6852 bp, Homo sapiens
  misc_feature (4301)..(4301): n is a, c, g, or t
  misc_feature (4761)..(4761): n is a, c, g, or t
  misc_feature (5306)..(5306): n is a, c, g, or t
  misc_feature (5843)..(5843): n is a, c, g, or t
  misc_feature (6096)..(6096): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagtgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432576 - DNA, 3031 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgccggggaagtataaagcgttgag

SEQ ID NO: 432577 - DNA, 5871 bp, Homo sapiens
  misc_feature (3320)..(3320): n is a, c, g, or t
  misc_feature (3780)..(3780): n is a, c, g, or t
  misc_feature (4325)..(4325): n is a, c, g, or t
  misc_feature (4862)..(4862): n is a, c, g, or t
  misc_feature (5115)..(5115): n is a, c, g, or t
ctggtacgggagtggacactgggtgagtcataatagtccagctcattgagctcctgtgcgatggcggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432578 - DNA, 6794 bp, Homo sapiens
  misc_feature (4243)..(4243): n is a, c, g, or t
  misc_feature (4703)..(4703): n is a, c, g, or t
  misc_feature (5248)..(5248): n is a, c, g, or t
  misc_feature (5785)..(5785): n is a, c, g, or t
  misc_feature (6038)..(6038): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432579 - DNA, 6005 bp, Homo sapiens
  misc_feature (3454)..(3454): n is a, c, g, or t
  misc_feature (3914)..(3914): n is a, c, g, or t
  misc_feature (4459)..(4459): n is a, c, g, or t
  misc_feature (4996)..(4996): n is a, c, g, or t
  misc_feature (5249)..(5249): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432580 - DNA, 5468 bp, Homo sapiens
  misc_feature (12)..(12): n is a, c, g, or t
  misc_feature (17)..(17): n is a, c, g, or t
  misc_feature (23)..(23): n is a, c, g, or t
  misc_feature (2917)..(2917): n is a, c, g, or t
  misc_feature (3377)..(3377): n is a, c, g, or t
  misc_feature (3922)..(3922): n is a, c, g, or t
  misc_feature (4459)..(4459): n is a, c, g, or t
  misc_feature (4712)..(4712): n is a, c, g, or t
ctttgatggccnttcgnctactnctactatgctgcgagaagacgacacgaatggggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432581 - DNA, 3150 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctcggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatgcaaaaacaaaaaaaaaacct

SEQ ID NO: 432582 - DNA, 6460 bp, Homo sapiens
  misc_feature (3909)..(3909): n is a, c, g, or t
  misc_feature (4369)..(4369): n is a, c, g, or t
  misc_feature (4914)..(4914): n is a, c, g, or t
  misc_feature (5451)..(5451): n is a, c, g, or t
  misc_feature (5704)..(5704): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432583 - DNA, 3343 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatggtaacgtaaaccccaccctctgtctgccctggtgagaaggcagccagctggcgggagcagccaagtcccaggagtggcaggctggaggccctcaggctaggggctgccctccctggaggagccccagggcccatgtccttggggaagatggctccctgaaagccggcccggccacgggcgtgtgtgtatccgggaggcctgacctcctcgcctcaatctctgtgccacttcatcttctggtacttctcactcccactgtggacagctgggctgaccctgaggctggcaggaaggactggtggtgtgggacatcccaggtttcgggctggcatgcgtcacctcacatggagcatggaaaccgagacttccacctctgtcctggcggtgactctggttgggcctgccgcccctctggattgtcccaggccgtcccccaccccccaaccttcctagtctgtccccccttgcacagacattctgagcagagcagtcaggtgactcctgagccatggtgccaagtgcagagcccacaggctgtccagcgcagggcatgggcatggggctaggagcagtgaacctgggagtaaatcccagccctgccgtcattagtgtgttacctcaggtgaagtgggggaaccctacaggactgttacaaggattaaatgaaggaatttaagtgtgtgcatgtatctggcatgtagaaaatacagtgtggtggggagagaa

SEQ ID NO: 432584 - DNA, 2613 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggag

SEQ ID NO: 432585 - DNA, 5134 bp, Homo sapiens
  misc_feature (2583)..(2583): n is a, c, g, or t
  misc_feature (3043)..(3043): n is a, c, g, or t
  misc_feature (3588)..(3588): n is a, c, g, or t
  misc_feature (4125)..(4125): n is a, c, g, or t
  misc_feature (4378)..(4378): n is a, c, g, or t
atcctcccgatctcctccatcttggtctggatccagggcccgatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432586 - DNA, 5140 bp, Homo sapiens
  misc_feature (2589)..(2589): n is a, c, g, or t
  misc_feature (3049)..(3049): n is a, c, g, or t
  misc_feature (3594)..(3594): n is a, c, g, or t
  misc_feature (4131)..(4131): n is a, c, g, or t
  misc_feature (4384)..(4384): n is a, c, g, or t
tgcgtagcctctcattgtgctgctgtcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432587 - DNA, 2493 bp, Homo sapiens
  misc_feature (2424)..(2424): n is a, c, g, or t
  misc_feature (2442)..(2442): n is a, c, g, or t
  misc_feature (2488)..(2488): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaccttccaacaaacaaggcaacaaccaaacttacaaccaattgggangcaacaatcccgtttttngggccttggggaaaccaaaccttgcttccaaccaaacccaatccgnccaaa

SEQ ID NO: 432588 - DNA, 2430 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggtgagagccccatcctgtgctttcttagtgcagcccccaacccctgccccagggccctggag

SEQ ID NO: 432589 - DNA, 5909 bp, Homo sapiens
  misc_feature (3358)..(3358): n is a, c, g, or t
  misc_feature (3818)..(3818): n is a, c, g, or t
  misc_feature (4363)..(4363): n is a, c, g, or t
  misc_feature (4900)..(4900): n is a, c, g, or t
  misc_feature (5153)..(5153): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaagtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432590 - DNA, 5166 bp, Homo sapiens
  misc_feature (2615)..(2615): n is a, c, g, or t
  misc_feature (3075)..(3075): n is a, c, g, or t
  misc_feature (3620)..(3620): n is a, c, g, or t
  misc_feature (4157)..(4157): n is a, c, g, or t
  misc_feature (4410)..(4410): n is a, c, g, or t
aaggcacgatggcgcgtcctgtgtgcagatactccctgcttccctctctagcccccaccctgcagagttggacccctgagctagccatgctctgacagtctcagttgcacacacgagccagcagaggggttttgtgccacttctggatgctagggttagactgggagatacagcggtgaagctgaaatgaaaaatgtgttgctgtagtttgttattagaccccttctttccattggtttaattagggaagcgcacgatggcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432591 - DNA, 2052 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagttgcagaatactggatttaaaaggttttgccaggagctaaggaagctcatgttgtgggaggtcacctgggtagtgagcctctggagcagcccttctccctgacctgtgaggtggtgaacacaccagagaggttgctgctaatttga

SEQ ID NO: 432592 - DNA, 1784 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggaccccccccgcaactggggatactctagatacgaccaacacgcatgcagcgtg

SEQ ID NO: 432593 - DNA, 1761 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgagagaagggctatgaggagcggacatgatgctgtggaagtagtttgaggaacatcctatgagttttcttagaatgtataaaggttgtagcccgtccaacttcaaagaaaaaaatgaccacatactttgcaatcaggctgaaatgtggcatgcttttctaattccaactttataaactagtaaaaaagtgtttgcttattccaccagttctactgggacatactcgagtataaagaga

SEQ ID NO: 432594 - DNA, 4578 bp, Homo sapiens
  misc_feature (2027)..(2027): n is a, c, g, or t
  misc_feature (2487)..(2487): n is a, c, g, or t
  misc_feature (3032)..(3032): n is a, c, g, or t
  misc_feature (3569)..(3569): n is a, c, g, or t
  misc_feature (3822)..(3822): n is a, c, g, or t
ccaggatcttgaaggaagccatgacttggtctgctgtatctgtgtcggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432595 - DNA, 4572 bp, Homo sapiens
  misc_feature (2021)..(2021): n is a, c, g, or t
  misc_feature (2481)..(2481): n is a, c, g, or t
  misc_feature (3026)..(3026): n is a, c, g, or t
  misc_feature (3563)..(3563): n is a, c, g, or t
  misc_feature (3816)..(3816): n is a, c, g, or t
atgtatatttattaattcacacacacgtaacgtatcgaccggggacgctttagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432596 - DNA, 1717 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcgggtgagcactgggggtgagcctgggcccccagactggactgcctccacctctgagctgctcctagttgtggtcaaattcagctttatgggggtgcggatgggcgtgtttgcttctacctacatacactgctccagaagtcacttcccccttccagttaccacccaggctcaatcccaaactcggccatgtggggcagccccctctgcccagaccattctgggtcaggcttgcccttccagacccctgagcatctactccagacctccctctcacaaaaaatcatccctatgaacacaatgcttttgacaccctgaaccaaacagggcataattgaatcgcagtcaagttgatttctactt

SEQ ID NO: 432597 - DNA, 1404 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaagcgcatcacccgttcgaaacgggtgatgcgggttgccgaaaggcacagagcaacagaggaatcctgaccctgaagtacccgatagaa

SEQ ID NO: 432598 - DNA, 5280 bp, Homo sapiens
  misc_feature (2729)..(2729): n is a, c, g, or t
  misc_feature (3189)..(3189): n is a, c, g, or t
  misc_feature (3734)..(3734): n is a, c, g, or t
  misc_feature (4271)..(4271): n is a, c, g, or t
  misc_feature (4524)..(4524): n is a, c, g, or t
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcaggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432599 - DNA, 4496 bp, Homo sapiens
  misc_feature (1945)..(1945): n is a, c, g, or t
  misc_feature (2405)..(2405): n is a, c, g, or t
  misc_feature (2950)..(2950): n is a, c, g, or t
  misc_feature (3487)..(3487): n is a, c, g, or t
  misc_feature (3740)..(3740): n is a, c, g, or t
aggacatgtagtccagagcacctggcacggagtcggggccggtgtagggggccatccgcgcgatgcagtactcagcctgggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432600 - DNA, 4694 bp, Homo sapiens
  misc_feature (2143)..(2143): n is a, c, g, or t
  misc_feature (2603)..(2603): n is a, c, g, or t
  misc_feature (3148)..(3148): n is a, c, g, or t
  misc_feature (3685)..(3685): n is a, c, g, or t
  misc_feature (3938)..(3938): n is a, c, g, or t
atcctcccgatctcctccatcttggtctggatccagggcccgatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccggaagaagacaggcatgatggacacggatgatttccgcgcctgcctgatctccatgggttacaacatggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacagctctttgcctgctccttgcttgatgttttctggaagtgtgtgtggggtcaaggatggtgtggggcacctgtatctactcctaatgtttttgaccctgctgtgttcaatcttcttacacttcagtttcttcattttaaaaaggaaaaggtaatttcttcacagtctcctatgagttggacagaaagtcatggatgtgtaaaggacttcttgatgataagccccaccttcatttttccacggcaccaaacagccctgtgacatctgcattcaccccactcgtttttatttttgctgcagtgaacagcttgagttgtctcttaagagtcatctcatcccttgctattcgagatgacccacagatggcagctgttcagcatcacctgggagttcattggaaatacagaatctcaggccccacccctgaatgtcgaatactgtgtgtactgctctagcttctccagagtaaaagatagtctctataggatgccgtctgctctggcaccaggccccctgagcccatgccttttatctgacgtttgttttgcaacccattacatcacttgcccccgggcatcctttaaatttcatccttggctaattctcattgtaaccggttccagcttgctttaaatgattgggtggatggaattctccccattgacaattgacaggtggcaattaattgttcatgcctcagtgggatgaatccattacatctctttcctgcctaatatttttatctacctccgacttttttgtagggactttgttgatatcctcatgaaggcccatctctcctctctctggcttgtccatcccttgacaaaaccttaatgactgttctgggtaccaaatctgtggcaggagtgtgacccagctgccacccacctcctccatcactggaccagctcatagttgtcccttggacatggggttagtgcccaacaagtgtagtcatttggctaagtgagttactaggagggagaacagattcaatttcctgaggtggtgaggagagactgaaggctttgccagttctttggcctatgccaggctctctggtacttctgcnggtggcatgagctgtgtgaagcgcctctaaatttaaggctccaaagctctccaacacaaacaagactttagggtctgcgttatggacgccaagggaagaaatacaacctcaacatcagtgcctgtcaagggaggcagatgtgagctcgtctgcctgccaccggccatttggactaccttgggcaagtgacctccttaaatggggccgataatgttgctttccttctctccctggcacacagtaggcatttaataagtggcaatgggtattgtccctagagttgtataaaaaaccagctctagcagggcgtggtggtgcatgtccgtagtgccagctgcttgggaggctgaggtgaggatcacttgagcccaggagttttgagtccagcctgaacaacataacaagaccctgtctgtaaaatgggggaaaaagtcagctgtgctttgttatgctgtttaanatattcttaaagaaaaaggcctgattacagaaaaataccattaaggggaaccctctttcagtctctgtgctgagggtagtagtaggctgagtaatggtcccccaagatatccatttccgagtccctggaacccatgattgttaattcatatgacaaataagactttgcagatgggattaagaatcttgaggtggggagattggttctggattatctgggtgggtccttagggagcaggcatgtcggcatcagaggaaatgtgacgacagaagcaggggttggagtgatgtgaggccacaagccaatgaatgcggacagcctctagaagctagaaaagccagggaaacagattctccctgagagcctccagatagaatgcaggtctacagacccattttgggtctctattctccagaacttgagataatacgtttgtgttgttttaagccacttcatttgtgataatttgttacagcaaccataggaagctaatatgtgctccatcgttcatgccctggggagctggctgcctccctgacgtcagngacccgtggtataggcatgacctgctggagaaactgccctagcttcaaaggcctgagtgtgcaacattggcccttgggaggctgccttagctgctggacttgatctcctaagccttaaaagcgccattcatggagaggggagaaggaagcttccaagttctgagagcccaaaaaggccagaatagctgggcccagcaggagatgtaaggcttcctgttgtctcagatgcaggagccagagggcagcccagctccaggtaggcaccagccacagaactggaaagcccttgggaggctgaggtcctgccttctctatagcttatcttggcccctctctgtgtgtcagcctccctcctctccctgcagcccagctttgggtgcacacctccccatggtggcagaggtcaattccacagtgcctagtgttgacattttcttgacacgagactagtcccaattccaaatgtccaggaggcacttggcccagtctgacctggtgtgataaagtgatgcctgtcagtggataaggctggggccnttgctcatgggctagattgggtatcacctttaggataacccaaaaggtggcctcataagaactgtctcagttcatcaattttcacattttagcatctctgatattgagatagagcatacaattgatctcactttaggattaatggtgtcttacaattgctgttggccagatagcagtcatgacttagtgtcattgcctgcctatttgagacaggaatgtgagtcctgtcttttgtctcaaaaacttccattantcttacctcctggtaagatcaagctccagtatcaaaagttgcatagtgggtacccagagagaaaatgctgatgatcatagtgtagtactggcttacgaaatgctagccagggtgcaatggctcatgcctataatcccagcactttggcaggctgaggtgggcggatcgctcgagcccagaagttcaagaccagcctgagcaacatgatgaaactccgtctttactaaaaatacaaaattagccggatgtggtgccgcatgcctgtaatcccagctacttgggtggctgaggcaggcgaattacttcaacctgggagatggaggttgcagtgagccgagatcatgctgaaggaaggaagggagtaagggagggagggaggcgagagagagagaaagaaaaagaaatgctgcattttcagttctattgatggcacagcaggcaacggtgtgtgaaaaacaggcacttaaagactctgggccgggcacggtggcccatgcctgtaatcccagcactttgggaggctgaggcgggtgaatcatgaggtcaggagttcgagactagcctgaccaacatggtgaaactatgtctctactaaaaatacaaaaaattagctgggtgtggtggtgggtgcctgtaatctcagctactcgggaggctgaggcaggagaattgcttgaacccgggaggcggaggttgcggtgagccgagatcgcgctactgcactccagcctgggtgacagtgtgaaactttgtctc

SEQ ID NO: 432601 - DNA, 1229 bp, Homo sapiens
agcgctagtgtgtccgcctagttcaagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaagcggagacacagcagcacccaatcgcccatcttgccaaggcgtaggccggcaacgcagcgacgaccgagcagccctggaagacacgagaagacggcccggaccgggccggcgccccgccacacccggggcgagaccgcgccgacacccccgcccccgcgaagaccgggccgccacggcaacggcacagcgcaggcca

SEQ ID NO: 432602 - DNA, 461 bp, Homo sapiens
agctaattcttgaagtttgaaaaactgttgtctcaaaatttacacgtgtaacacgactagctctgaacagcttcccagcttgctttttctgtttctcaaataacttctcaaactctgtcaagggaatagacttgatggccagggctcctccttcagtagctgcagggttggcatcaaagggtcacagtggggcctcctgtgagccggcatccctccctccaccgagtcagccctctgacctcgctgcccatccccttccccatagagagacttcagccaaggaagggctgctcctgtggtgtcagagaaagacagccccttacaaaaatgtcaacatccagaacttccacataaggtgagtgctggggtctgaggggctctcacagaaccaggctgcctcccccgggagctcccagacccccttggctgggtcagtctcagctttagaacaaagtggagac

SEQ ID NO: 432603 - DNA, 169 bp, Homo sapiens
atgactcacccagtgtcaacgcccgttgccaaaagatctgtgaccagtgggacaatctgggggccctaactcagaagcgaagggaagctctggaggtgagaggtcccagagggagatctaggcccatatccggcagccctgtggtgccccttcctgcttcttgactctc

SEQ ID NO: 432604 - DNA, 389 bp, Homo sapiens
gtaggtatttcatccaatgataacagtgcttgttatatacctctgtggtgctgtttccatacctaagagcacccatgctaaaagtgtcttactaattaccagtgatggcctccttagggctgggatgggaactgagaatcatttgagggcttaataagtgattttggaggccccagtccccaccctatgggagcagagtgaggtggtctgacaaggtgcttccttcccggtgagcaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcga

SEQ ID NO: 432605 - DNA, 2941 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432606 - DNA, 551 bp, Homo sapiens
tgttccttgtggttctggcagcgtgaggacaggacacatggagagagaccctttaaacctccttccaaggaagtcagttctccctggtccagagattgcaaagtgtaattatttttcaggagaaaaatactatttgtctgcgtttcttagttcgtctctgcacagatcttggattaaaagatgctcaagaatatgccagaaaactgaagaggttggaaaaaatgaaagaaataagggaacagcgcataaagtcaggcagagatggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcatgactgtgtagaacattttccacatcagacagtgtc

SEQ ID NO: 432607 - DNA, 3269 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432608 - DNA, 3170 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaaaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432609 - DNA, 3167 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctgaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432610 - DNA, 1991 bp, Homo sapiens
cctagtttagaagtttcaatagcacctagctttagaagtgtcaatagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432611 - DNA, 3216 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432612 - DNA, 926 bp, Homo sapiens
tgttccttgtggttctggcagcgtgaggacaggacacatggagagagaccctttaaacctccttccaaggaagtcagttctccctggtccagagattgcaaagtgtaattatttttcaggagaaaaatactatttgtaagcatcattcctacctgtatcccaaaagactgagttcactgatttattgagcttttaacaaatatactgtgcctatattctttcctaaatgtatattttacaatttaggtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432613 - DNA, 892 bp, Homo sapiens
gcatcagctggacgtcgttttaaattaattacaaggtatgacgatgtttctggaggagatattgcaaagtgtaattatttttcaggagaaaaatactatttgtaagcatcattcctacctgtatcccaaaagactgagttcactgatttattgagcttttaacaaatatactgtgcctatattctttcctaaatgtatattttacaatttaggtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432614 - DNA, 3158 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432615 - DNA, 634 bp, Homo sapiens
aggttatgtgattaggagtagggttaggatgagtgggaagaagaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacata

SEQ ID NO: 432616 - DNA, 2587 bp, Homo sapiens
cgcaccacccccttggcgccgcgtctctcccgcgcccgcgcttccggccccgcgcgcgcccgcgcggaggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacaatagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatgtatcttatttgaaaaccttagggacagttattaattctctcaattggtgattgaagatcaattattaaataagtttaactaatgaagtaattgatgaggataatatttgaagtaagtgatgaggataatctggcagattattgtgtgataaatatcatttgagtaatcctattttaagatgtagtttgcatcgaaagaggaattaatggttaaaactattatttattaaattttgaaaataactgaagtaattaggacattttcggtacatataagccattcattgaaagtcaatttggtgctttagaacgttgtattaattctgaagcttgtagggtatcattgaagcactaacttactaaataaaatactgtttattactg

SEQ ID NO: 432617 - DNA, 473 bp, Homo sapiens
ctgtcggccccggggcggtctgaggcggggccccagatggactcggcctgcccctgcttttcttcctcaggctcccgagttgtctactcagaaacgcgggcgttgtttctcacatcggtgtccccagctcacaggcttttcttgctcctctgaactgggacgggcgtcgctgaccgcttggcgatgtcccaagtcccagtcacgcctgacggggaaacttaaaacccagttagattactgcgccagctctggaatcgcacagcagagatggtgcacatcgctctttaattttcttgttaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgatt

SEQ ID NO: 432618 - DNA, 429 bp, Homo sapiens
gtactctccacccagttcctccaggcatagcaggtctgaagaagaatggtgagatggccaaaaggtgttgctgggaattcttaagaatttgatatttacagataaaatttaaaatgacttgggagaccatttctgttcactctgagttattcattttgactatgagcctgattggtttcacatttgttttgtttgtttacataactctaacgtgacaatctcttcgaaacctagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaa

SEQ ID NO: 432619 - DNA, 975 bp, Homo sapiens
gaggttagcccatgactctgagaggaactccgggcttttcttttctgtttaagtgggtgaaagttcacctctccagggcatatggtaactgcatccctttgtgtgaattcccggaccttcaccaccagcatgtttgctgggggtgcagtgacaggggaaattttaagaaatgcatgaaatcttccaagaaggttgttgagtttttagacactaccttttatttcagaattttaaagtacacattttttttttctttccaatctccatgccctcactgccctctcacccatctcattcctcccccagtcccaaagggtaaaggaggcaacaaatgcacagaagagttgccatggtctgggccaccaggaaggggatcagcttgaagacttggattgacttctgaatatattgcttatcagtcagggtgttgaatgcctggcactgttcccccagtggaacttcataccggtgtgtctaagggcaaaatggaaccgtagtgttctgactttagaacctgatgtcagaaatgaagaccggaggggcttttagagagaatgtaacatgcactccagtcatgatcagtgaagccctgtgcatgcggtttgatttggttttacttctctacacgtctgtgctcttcctgttttcagagaacagtggcaatattctgtgaaattgccccttccttgtttgattaagagtttgtcattcttacctatacctttggatcctctaaaaagaaaaaaaacaaacaaaccctgttcaattatttgttgcacaaacgttaaaactgttaaaacaacaacaacaacaacttcatttaggatgctaccctctcagcttattgaactgactttttaattatttttgctggacactgatctctccattccttattagcacagttgtaatgtgatttttgcgctattattcacttaaaaactaaaaatacaggtattttcttttggtgtggca

SEQ ID NO: 432620 - DNA, 2731 bp, Homo sapiens
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgtt

SEQ ID NO: 432621 - DNA, 992 bp, Homo sapiens
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcgtcccaaagggtaaaggaggcaacaaatgcacagaagagttgccatggtctgggccaccaggaaggggatcagcttgaagacttggattgacttctgaatatattgcttatcagtcagggtgttgaatgcctggcactgttcccccagtggaacttcataccggtgtgtctaagggcaaaatggaaccgtagtgttctgactttagaacctgatgtcagaaatgaagaccggaggggcttttagagagaatgtaacatgcactccagtcatgatcagtgaagccctgtgcatgcggtttgatttggttttacttctctacacgtctgtgctcttcctgttttcagagaacagtggcaatattctgtgaaattgccccttccttgtttgattaagagtttgtcattcttacctatacctttggatcctctaaaaagaaaaaaaacaaacaaaccctgttcaattatttgttgcacaaacgttaaaactgttaaaacaacaacaacaacaacttcatttaggatgctaccctctcagcttattgaactgactttttaattatttttgctggacactgatctctccattccttattagcacagttgtaatgtgatttttgcgctattattcacttaaaaactaaaaatacaggtattttcttttggtgtggca

SEQ ID NO: 432622 - DNA, 989 bp, Homo sapiens
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggtgagagggatggcgtcccggtcccgctgcccgtgtcagaagcgggttcccaaatcccgccgttaagcgcacggctcccggctcctcacctggattcatcctgggtggatcccgcaccttggccagggatcagttccctggggattccccaccctgctgtccctgggcgatccccttcctccaaggatgggagctcctgcctcacccgggtctcccctcgcgatctgcggacctcagatggattcccggccccgggactccaagcctgtcctccttcccggggatccctttgctcctggggctcaccctcccgacccccatacaggctgggctctggctctctctgggaacccgaaccccagccccgggcaccgcccccgagtcctccgacctggctttggcctccatccctttacctccagggtgggggtctcccggggcgcgcggaacggggtggcgccctgcggagagatttgtcgtaaagcggggtgctaggcattttgggtgctttgtgaacggccctagcaacagggaaactgaggcacgctccgccagcttagccctgcctggccgtgtaggggccttgctggttctccagctgaacgtcccagggcggtgctatttttgggctctgcgaaggggcatgttagctttcgggtggcgaga

SEQ ID NO: 432623 - DNA, 2677 bp, Homo sapiens
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgtt

SEQ ID NO: 432624 - DNA, 2684 bp, Homo sapiens
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcagtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgtt

SEQ ID NO: 432625 - DNA, 2171 bp, Homo sapiens
  misc_feature (2143)..(2143): n is a, c, g, or t
  misc_feature (2171)..(2171): n is a, c, g, or t
agccgggctccggggcggggcgcaggagccccggggcggaggagccggggaggcgggaggcgggaggcgggaggtgttggggccgttgaagcggcctccctcccgcccccagccgcccggtctggccccagccctgtcccgacccgcggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggacagatgtctacgactgatncatactaatcttgcatggttagtatagn

SEQ ID NO: 432626 - DNA, 5803 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaaga

SEQ ID NO: 432627 - DNA, 1115 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtatgcaaagcattgagtttgctacattttcccccttgttcgttgaattttgttatgtgtattctg

SEQ ID NO: 432628 - DNA, 613 bp, Homo sapiens
gaatgtcatatattctgaaatcatcagaatgtgctaaagtttaaacagtgttatttatattcttcatgataaagagaaacaaagcctatgaaaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacga

SEQ ID NO: 432629 - DNA, 8063 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432630 - DNA, 7082 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctga

SEQ ID NO: 432631 - DNA, 8009 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaatattgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432632 - DNA, 9095 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacgatgtttgtctttctttgtgttttgtctcataatcttttttcagatgcaatatgccggaaaaagttataggtccagtttgaaaattatttagtttttctgcctatgctagtggaaaaatagtaccaggatcagaatacagggtatcacctatggaatgtttctgtatttatgaattgactcaaaagaaagctttgtttctgaaatcgcattatgtagtagccacagttttctgtttgtagctcagctagattgttatatatgttcaatcatttcacaataacaacacaaaactggtcattgaaaggtttttatgtacgcattttaaacttgttcgttaaaaatttggtcctttttccaggtgaggcccagttagaataatgtgtcccggcacttttaggcacagcaaggatgaattcaatatccccttttcacttagcaacaatgtgttacttctaccctaataggaattgggaaagcaaagttgtatgagaaacagactctgctgataaagtactcatagtccagaccagagaaatataaatggaaataggttatatttcaatagtgattggttcatctaaaagtctctgctgtaaaggaaataaagcatagaggtttgagcatggactttggagttggaccaatctgtgactgattcttcgttctgctacttgcttccaatgtgaccttgtacaagtttcttgacattctctgagcctcagtttctctactggttgaataatccttgataggattgcagtggaaaattaaatgaaataatgttagcaaaggtcccaacataatatttgacttggaattgaatgcccatggtaaccagcatcattttccttcatgtgatgtcttcttatgcctttgaaagaaagttactttatcaaatgtataaataaagatctgtttataggtgatctttttaatttagaagaaattctgagacacaaataaaaaaagaaattttttattatgtggttcaatagattgtctaaagcatggcagtaaagttttaattatgcca

SEQ ID NO: 432633 - DNA, 8689 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacgatgtttgtctttctttgtgttttgtctcataatcttttttcagatgcaatatgccggaaaaagttataggtccagtttgaaaattatttagtttttctgcctatgctagtggaaaaatagtaccaggatcagaatacagggtatcacctatggaatgtttctgtatttatgaattgactcaaaagaaagctttgtttctgaaatcgcattatgtagtagccacagttttctgtttgtagctcagctagattgttatatatgttcaatcatttcacaataacaacacaaaactggtcattgaaaggtttttatgtacgcattttaaacttgttcgttaaaaatttggtcctttttccaggtgaggcccagttagaataatgtgtcccggcacttttaggcacagcaaggatgaattcaatatccccttttcacttagcaacaatgtgttacttctaccctaataggaattgggaaagcaaagttgtatgagaaacagactctgctgataaagtactcatagtccagaccagagaaatataaatggaaataggttatatttcaatagtgattggttcatctaaaagtctctgctgtaaaggaaataaagcatagaggtttgagcatgga

SEQ ID NO: 432634 - DNA, 7635 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcgtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432635 - DNA, 7464 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgaaaaaaaaaaaaaaaaagaaaaaaaaaaaaaaaaaaaaaaaaaacgaaaaaaaaaaaaaaaaaaaaaaaaaaaaaaaaagaaaaaaaacaaaaaaagggggggggggggcataaattcccgggggggggccaatagaatgcgcccacacggtttatgggaagaggagccgcccccatacagcgggagcgtgtaaaacagcccgagccacgcgcggctaaaaacacacgacggcgaagcgaaccaccaccgacgccgaacacactgggagagccacccatgtggggggagacgacacggggacacacaccccaacgaaatacggcccagcgacaatacaatacgaggcgaaaggataaacccccaactgctgggagacaaaacg

SEQ ID NO: 432636 - DNA, 5904 bp, Homo sapiens
gaatgtcatatattctgaaatcatcagaatgtgctaaagtttaaacagtgttatttatattcttcatgataaagagaaacaaagcctatgaaaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432637 - DNA, 4977 bp, Homo sapiens
agttcgacggagactctctctcgccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432638 - DNA, 5361 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaagggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtgttacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432639 - DNA, 2517 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctga

SEQ ID NO: 432640 - DNA, 1205 bp, Homo sapiens
  misc_feature (52)..(52): n is a, c, g, or t
agagagagagagagagagagagagagagagagagagagagagagagagaganacggcacgaggtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacga

SEQ ID NO: 432641 - DNA, 4296 bp, Homo sapiens
  misc_feature (4167)..(4167): n is a, c, g, or t
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacacttngcatccagagacactttgcatccagagacactttgcatccagagacactttgcatccagaggcactttgcatccagagacactttgcatccagaggcactttgcatccagagacactttgcatccagag

SEQ ID NO: 432642 - DNA, 2772 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacga

SEQ ID NO: 432643 - DNA, 2544 bp, Homo sapiens
cgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggtaggcttgtctttgaatataaaatgttacaaaattaattcttttatttaaaaatatgctttaaagtcctgcaagactcaggtcaagtgcttccatagttaataaagcatgactttttcagctgtttccgaaaaatagctttttctcctgtttcccacctcacttttgaatacactacatgtctttctccattggccttttatctatggttttagcacagtacctggaacatatacatgtcaatttatttcatttgacaaataagttataagcccagtaaagtaggccaagataagggcttaatgaattatagctctggagccaaatcttgcccaccacctgtttttgtaaataaaattgta

SEQ ID NO: 432644 - DNA, 446 bp, Homo sapiens
aataagatttttctttaacttgcttagagtcattagtatatacacatcctgaagtacataataaaactcagactaacctaccttctgtaatgtatctttcttgcttgagatagtggcttatggagaaataaaatatttatctacaaatttttaagttagcattttgattgtattcaagtagagaatattttcttagatactcatactaagatttaaaatttgatattttatatttgacttttctcttttttagataatgcctcccaacctgagaccaaagccatcattgaaaatttgattcaaaaacaggactttagtctttctgttgccttagatggtggttccatgctggtcacatatccttatgacaagccagtacagacaggtatgtagaatgtcattttatatatatactgtttaagcttaggtagcaaatcccaattaag

SEQ ID NO: 432645 - DNA, 455 bp, Homo sapiens
cggccgcgacctcaaccgaagctttcccgaccagtttagcaccggcgaaccccccgccctggacgaggtgcccgaggtgcgcgccctcatcgagtggatccgcaggaacaagtgagtgttgcctgccccctccccgtccgtgtgagcctccaagggccgaggctggttccggcacccagtaggcgctcagacaatgctggcataaggggtggcggtggtgaaggtgaagggagacaccctgtaacggggacagggcccaggccgcgtagcctcccgtcctgctaatcatcaaagaattgcctcctagaggctgtcatttgttcaagggatggctggaggggacactcctttctgacatttctggtccctattcttacaggggcatagaatatgagcgagaagagatcttaaggataacctaggtcagctcacacattttatagataagctgtcaa

SEQ ID NO: 432646 - DNA, 1891 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432647 - DNA, 1997 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaaggggaccagtagacggggtggattcgaggtggggacatgggacgcagcggtcggagccgcctggaggggtacccggtggtcccgatggagctatcatctttgagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432648 - DNA, 397 bp, Homo sapiens
gggtgcaagggacaggaagcaggagggactgaggtgcacacggcccccgagaagtgtgcgctgcctcacgaccacacacaccagaccgaggccaagagatcgaccgcgatgcatccgtacacccacaccagaacaacacgagctccagcaggaatctgagagcaatcagcggacgggctcaggaaccctcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctct

SEQ ID NO: 432649 - DNA, 1951 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 432650 - DNA, 2082 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatatgtgagtcacttttctttttcttgggtagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432651 - DNA, 1693 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432652 - DNA, 1854 bp, Homo sapiens
cgaccacgcaacaatataaaaggaaaatctatacggctagtgacgaggcctgcgtgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432653 - DNA, 1994 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432654 - DNA, 1853 bp, Homo sapiens
ccggaaagggggggaaacaacctttacggctaggtactgaggcctgggtggtgtgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432655 - DNA, 1837 bp, Homo sapiens
aacttaggctatgtactgagacctcgggtgttaattcggcagaggttcgaccgcgaatatgcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432656 - DNA, 1829 bp, Homo sapiens
cttaggctatggtctacactacgctgttacacgccggaacaggcctagttccgcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432657 - DNA, 1440 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaa

SEQ ID NO: 432658 - DNA, 1976 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432659 - DNA, 1630 bp, Homo sapiens
  misc_feature (1630)..(1630): n is a, c, g, or t
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaaaaaaaaaaatataacctaaaaaataaaaaaaaaaagctggatttgggactgatggagatgatcaagaggcaattaatgaagctatatctgtgaaacaggaagtaacagacatgaactatccatcaaactcatagtgtaataattgtgcaggtacaggaattgttccaccagctttaggctttagcatgtn

SEQ ID NO: 432660 - DNA, 2171 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432661 - DNA, 2277 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaaggggaccagtagacggggtggattcgaggtggggacatgggacgcagcggtcggagccgcctggaggggtacccggtggtcccgatggagctatcatctttgagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432662 - DNA, 1387 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaa

SEQ ID NO: 432663 - DNA, 1362 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432664 - DNA, 1450 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgc

SEQ ID NO: 432665 - DNA, 1546 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432666 - DNA, 1543 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaa

SEQ ID NO: 432667 - DNA, 1060 bp, Homo sapiens
  misc_feature (23)..(23): n is a, c, g, or t
  misc_feature (39)..(39): n is a, c, g, or t
  misc_feature (54)..(54): n is a, c, g, or t
  misc_feature (63)..(63): n is a, c, g, or t
  misc_feature (73)..(73): n is a, c, g, or t
taaaatattcaacttttatttgngccaatgtggttcaanttcgattgtgaaatnagaaatgcnctgaagaaanctgtcagcgtctttgtattcagctccatgcatttcccggactctgagacaaacaccctgtctggaccatttcttacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctca

SEQ ID NO: 432668 - DNA, 1490 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaa

SEQ ID NO: 432669 - DNA, 966 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaattccgtttattagggcacacaaaacaaaacacaacactttcgggcccgccccaaaattttcaaacg

SEQ ID NO: 432670 - DNA, 892 bp, Homo sapiens
  misc_feature (787)..(787): n is a, c, g, or t
  misc_feature (892)..(892): n is a, c, g, or t
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacaaacaaaaaaaaaaaattggggcggggggccnaaaaatttaacattgtggggggccaggagaagggcaggtcagaaacgcggcaggggggtcccaaacgggggggggaacacgggggctggtaagacaaacacgggn

SEQ ID NO: 432671 - DNA, 892 bp, Homo sapiens
  misc_feature (708)..(708): n is a, c, g, or t
ggacgcgtgggtcgacccacgcgtccggttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagagtgnacgggcatttatgggtcgatatggagggcaattgggcgttatgtaaagcggtggtttgactcaaatggtttagtagagaaaaacaaaattgggggggcaaattaaacttgggcggccaagatgatattcaaagaagggtataaaacagaggggaaaggagtgagaaacaacgtcgaaaagaaaa

SEQ ID NO: 432672 - DNA, 822 bp, Homo sapiens
tgctttgttgtctacttccttgtgccctccggagtcgagctctgtcagtgcatgattcttgccaatcgctaaacgtaggactcgaggaaggccattggcaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgctagacggagactcgccctgtcgcccaggctggagtgcagtagcgtgatctcggctcactgcaacctccgcctcccgggttcaaggaattctcctgcctcagcctccagagtagctgggactacaggcacatgccgccactcccagctaattttttattttttatttttatttttattttagtagagactgggtttcaccatgttgcccacgctggtctcgaactcctgagctcaggcaatctgcctgcctcggcctcccaaagtgctaggattacaggtgtgagccaccatgcctgaccgattctgttttatgtatggtatttagagagtgaaaatcactccccaggggtgttgtgagtaattagaaggtaagcataaagatagaaaaaaattatgaccctttatcctagagttatgctcactgtgtgacagcgatgtggtcttaccacatttggcagggtcttttcgtttcgtttcgtttcatttcatttccttgccttgccttgcctttcttttcttttttcttttcttttctttctttcttttcttttctttctttctttctttttttttttt

SEQ ID NO: 432673 - DNA, 1497 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaa

SEQ ID NO: 432674 - DNA, 1467 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaa

SEQ ID NO: 432675 - DNA, 955 bp, Homo sapiens
  misc_feature (828)..(828): n is a, c, g, or t
  misc_feature (881)..(882): n is a, c, g, or t
  misc_feature (894)..(894): n is a, c, g, or t
  misc_feature (899)..(899): n is a, c, g, or t
  misc_feature (902)..(902): n is a, c, g, or t
  misc_feature (905)..(905): n is a, c, g, or t
  misc_feature (910)..(910): n is a, c, g, or t
  misc_feature (917)..(917): n is a, c, g, or t
  misc_feature (955)..(955): n is a, c, g, or t
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagaggttgggattgctagatggtggctgtgcatttatggggtggtatggnaggggcaatggaccttatggttaaaggaggtgatttgcctaaatcgttttttnnaaaaaaaaaaanggggngcnaanaaaanggggggnagaagagtagttaagcggagtagattggttatatcagn

SEQ ID NO: 432676 - DNA, 969 bp, Homo sapiens
  misc_feature (785)..(785): n is a, c, g, or t
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagagtgnacgggcatttatgggtcgatatggagggcaattgggcgttatgtaaagcggtggtttgactcaaatggtttagtagagaaaaacaaaattgggggggcaaattaaacttgggcggccaagatgatattcaaagaagggtataaaacagaggggaaaggagtgagaaacaacgtcgaaaagaaaa

SEQ ID NO: 432677 - DNA, 1450 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaa

SEQ ID NO: 432678 - DNA, 1279 bp, Homo sapiens
ggacgcgtgggtcgacccacgcgtccggttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432679 - DNA, 1290 bp, Homo sapiens
gtaaggttatcctgctgttctggatcgccaggctctcctctccaagctgctggggtccaggactcggtgtcggaaccctcctgccccttctgaacacccttttttgcctctcttcacagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432680 - DNA, 1418 bp, Homo sapiens
tgctttgttgtctacttccttgtgccctccggagtcgagctctgtcagtgcatgattcttgccaatcgctaaacgtaggactcgaggaaggccattggcaattctgctaagaagacagtgcaagtgcctataaaaacgacagtttagggggaaaacaaaccaatacccggaaagctgagaggccagctttttaatcgtcatggttttatgtaaaataaaacagcacgtggaaggtattgtaagcgcttggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432681 - DNA, 1245 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432682 - DNA, 1442 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaa

SEQ ID NO: 432683 - DNA, 1302 bp, Homo sapiens
ggacgcgtgggtcgacccacgcgtccggttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagttccatctgtttatattttacagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432684 - DNA, 1935 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgccaatattaaatctgttggagtttcacgtataagacagaggagaaagagaacatcaaaaattacttagcaagctatggaatggagattcagttttcattttagtttgttaaatctacaaggctgtaaaatgattagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432685 - DNA, 1393 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatggagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432686 - DNA, 1849 bp, Homo sapiens
cctcttctcataccctgtgctaacaacttttaacaaaaaatttgcatcacttttaagaatcaagaaaaatttctgaaggtcatatgggacagaaaaaaaaaccaagggaaaaatcacgccacttgggaaaaaaagattcgaaatctgcctttttatagatttgtaattaataaggtccaggctttctaagcaacttaaatgttttgtttcgaaacaaagtacttgtctggatgtaggaggaaagggagtgatgtcactgccattatgatgccccttgaatataagaccctacttgctatctcccctgcaccagccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgccaatattaaatctgttggagtttcacgtataagacagaggagaaagagaacatcaaaaattacttagcaagctatggaatggagattcagttttcattttagtttgttaaatctacaaggctgtaaaatgattagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432687 - DNA, 1475 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgccaatattaaatctgttggagtttcacgtataagacagaggagaaagagaacatcaaaaattacttagcaagctatggaatggagattcagttttcattttagtttgttaaatctacaaggctgtaaaatgattaggtaatagaaaaagcttccatgattctatttattatatatgtgcattggaagaaactaccaggtgttactataaatattctatgtattgtttcagccatcctaatttaatgctgatatgctctagatttacattgctaagttttcactcttctcttgggcacttaactctgtttcttttgtttgtttgttttgagaaggagtctcactcttgcccaggctggcgtgcagtggtgctatcttggctcactgcaaccttcgcctcctgggttcaagcgatttttgtgcctttcttgagtaactgggattacaggcacgtgccaccacatccagctaatttttgtatttttagtagagatgggattcaccatgttggccaggatggtcttgatctcctgaccttgtgatctgcccgcctcggcctcccaaagtgctgggattacaggcatgagccactgcgcctggccaag

SEQ ID NO: 432688 - DNA, 1296 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgccaatattaaatctgttggagtttcacgtataagacagaggagaaagagaacatcaaaaattacttagcaagctatggaatggagattcagttttcattttagtttgttaaatctacaaggctgtaaaatgattaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaagga

SEQ ID NO: 432689 - DNA, 687 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaagttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaagga

SEQ ID NO: 432690 - DNA, 668 bp, Homo sapiens
aagcagtggtatcaacgcagagtcgccattacgccgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacttaactctttagggctttggatttgatttgccattgcactccagcctgggcaacagagcgataatccgtctgaaaaaaaaa

SEQ ID NO: 432691 - DNA, 416 bp, Homo sapiens
ggacgcgtgggtcgacccacgcgtccggttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagatggggtttcatcacattgcccaggctggtctcgaactcctgggctgaagcaatcctcccgcctcagcctaccaaagtgctgggattacagacgtgagccaccacgcctggcctgatgaaatttcattagagccgcatctcatcgtctggtccactgttgaatcaccagagccaactaaataggcccttactgaatatatgttgaataaatgcatcctttaaggc

SEQ ID NO: 432692 - DNA, 1356 bp, Homo sapiens
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcgtgactcacacctgtactcccagcacttttggaggctgaggcgggaggatcgcttgagctcaggagttggagaccagcctgggcaacatagacctcatctctacaaataatcaaaaaattaactgggcatggtggctcacatc

SEQ ID NO: 432693 - DNA, 2632 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432694 - DNA, 578 bp, Homo sapiens
gttccttcccagggagagattgacgctccggcgagtgattaccagtgtgcttttccattaaggtgtgtgacaggtgccgcaagataagcccgatttttacatgacatgctttttcctgcctttctgtgccctcaggacactgcccatctctaagataagaacctggaaaggggactctgttggccattggaaattgcagaataatgtctcaggtaagtcggtgtgtccccaaatcttcctgaaacactttattaggcctctgtgtgtttgctttgcttctcctgcctgttcccacctaatcaagtccatttaagggactagatctatggttcctttcactataggaagaatggagcccacaggagagctccaaggtattgtcctcatcacccagtgttcctcttttctacagttttctgctagaagactttctagattgccaacattttaaaactgtaattcacaatgcaactttggaatgtaaggttattcggtttatggttgtcaaaactgtaccatgtggtctcaagtgaagagatgtttggagtcatccttgattcttccttttgacttataac

SEQ ID NO: 432695 - DNA, 4392 bp, Homo sapiens
aaataatgaaaattgacttctcatggttttggtgcctgggaagtccaagatcaagaggcaggcatctggcaagggccttcttgctgtgtccttttgtggtggatgggcaaagagacgagagagaggcaaaggggggccagaactcatttttttaaataaggaaccctcttccctgatgatgacattaatccattcatgagggcagagtcctcaaggcccaatagtctcctaaagatctaacctctcaatactattagaatggtgattaagttcaatacatgcttttttggggaacataatcaaaccatatgtctatcagtctttaatattaagatgtcttttttttctgaacccattttttgtgagatttagtgaatctttctgagtatcatatttgagagacaattgctttagccttatttttaattacttagctagcatgtaagctataaaagatataactaaatacttgactctgtgctgtcaaatgtcaaatgttgatttttaaaaattcatataattctaaacttttaacaaaattactgaagcaaagctctcatatttgtctctcattcttattgtataaaaattctaagcacataactgtcccctttattgtataattccaactacataactgtcctattattacttacctgacatcacattcccagtcattgtcacagctcctgaatcttgttccatttcttccacaagcaggctaattttaccccttcttcagtgacagaagaggcctgggctatggctgagcctaaatatatttgctatttcaggtgacatttagtgatgtggctatagacttctctcatgaagagtgggcatgcctagattctgctcagagggacttatacaaggatgtgatggtccagaattatgagaacctggtctctgtaggtaaggatatcaccccttccactccaataggggacacctttcttttgccaccctgaattgctggagattctcctaagtaaatggctgaattctgtaccatgctcccgaggaaatgtgcagctctgttgtgccctgcctaaagcttatctttccatttcagtgaacacccttcatccattcctgtggtccctcttgtgatggcctctcataatagaggaccacagcttaaacaattctatatttttcctgtaagcaggtctgtctttccgtaactaagccatatgtgatcatgttattggaggatggaaaagagccctggatgatggagaaaaaactgtcaaaaggtatgattccacatgagtcatggtgaacgagacaaaggaagattttgttaaagatgtttatagtgagtgtggaagcattttagggatactgtcttcaaagatctcagatagaaatgaaaaattgagggatatttagcttagattttcaaaacaattgttcctccctctcaaattattatctgtatcactcatgtcacctaatcaaggttagaggtttttgccatcataataattcaaattgttactatattcatgacaaagtaagacaatttattctttcttaattctacttaagaaaaatatactaatagttttaagctaagaaaagctgtcagttagatggaaaatcacttttctaaagctgagctttgtagatgaaatatgaacatattagaggaagtaagggacatataaatgtttctaggaataatattttctaatgttcaagaaaaatatgattcacacagtttcttcataacctcagaaagcctatatctttgtcagctataaagagcatttactttgtttttactgcagttgtttaatatagtagtatcaattctgtattttaagcttgataatccagcagcaaattgagattaatggaaggttggaaaaaaaggctatgaaacaaaatgcaacctttcccacatgaatataggcacaaaatgatgatttgtaatcctgaatgccttccacatcttatttctgatactttccttttttccatactattttatccatttcgtacagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432696 - DNA, 2878 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagtttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432697 - DNA, 4747 bp, Homo sapiens
aaataatgaaaattgacttctcatggttttggtgcctgggaagtccaagatcaagaggcaggcatctggcaagggccttcttgctgtgtccttttgtggtggatgggcaaagagacgagagagaggcaaaggggggccagaactcatttttttaaataaggaaccctcttccctgatgatgacattaatccattcatgagggcagagtcctcaaggcccaatagtctcctaaagatctaacctctcaatactattagaatggtgattaagttcaatacatgcttttttggggaacataatcaaaccatatgtctatcagtctttaatattaagatgtcttttttttctgaacccattttttgtgagatttagtgaatctttctgagtatcatatttgagagacaattgctttagccttatttttaattacttagctagcatgtaagctataaaagatataactaaatacttgactctgtgctgtcaaatgtcaaatgttgatttttaaaaattcatataattctaaacttttaacaaaattactgaagcaaagctctcatatttgtctctcattcttattgtataaaaattctaagcacataactgtcccctttattgtataattccaactacataactgtcctattattacttacctgacatcacattcccagtcattgtcacagctcctgaatcttgttccatttcttccacaagcaggctaattttaccccttcttcagtgacagaagaggcctgggctatggctgagcctaaatatatttgctatttcaggtgacatttagtgatgtggctatagacttctctcatgaagagtgggcatgcctagattctgctcagagggacttatacaaggatgtgatggtccagaattatgagaacctggtctctgtaggtaaggatatcaccccttccactccaataggggacacctttcttttgccaccctgaattgctggagattctcctaagtaaatggctgaattctgtaccatgctcccgaggaaatgtgcagctctgttgtgccctgcctaaagcttatctttccatttcagtgaacacccttcatccattcctgtggtccctcttgtgatggcctctcataatagaggaccacagcttaaacaattctatatttttcctgtaagcaggtctgtctttccgtaactaagccatatgtgatcatgttattggaggatggaaaagagccctggatgatggagaaaaaactgtcaaaaggtatgattccacatgagtcatggtgaacgagacaaaggaagattttgttaaagatgtttatagtgagtgtggaagcattttagggatactgtcttcaaagatctcagatagaaatgaaaaattgagggatatttagcttagattttcaaaacaattgttcctccctctcaaattattatctgtatcactcatgtcacctaatcaaggttagaggtttttgccatcataataattcaaattgttactatattcatgacaaagtaagacaatttattctttcttaattctacttaagaaaaatatactaatagttttaagctaagaaaagctgtcagttagatggaaaatcacttttctaaagctgagctttgtagatgaaatatgaacatattagaggaagtaagggacatataaatgtttctaggaataatattttctaatgttcaagaaaaatatgattcacacagtttcttcataacctcagaaagcctatatctttgtcagctataaagagcatttactttgtttttactgcagttgtttaatatagtagtatcaattctgtattttaagcttgataatccagcagcaaattgagattaatggaaggttggaaaaaaaggctatgaaacaaaatgcaacctttcccacatgaatataggcacaaaatgatgatttgtaatcctgaatgccttccacatcttatttctgatactttccttttttccatactattttatccatttcgtacagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcaaaaaaaaaaaacacacaaaccaaaaaaaacagaacaacaaaagacacaacaacaaacaccaacaaacactcaacgcacaacaacaaacacaaaaaacaaaaggcgcggcaaaataaccacacaagcaaaacaccccaatatcaaacgcgacacaggagaaaaagagaagcgccgccacaaacaccacaggagacacacaccgcaaaaagagacacacacgagagaaaaacgaacacaacaaaaaaaccgagaaccacaaggaggagacatagcggcgaggagacaatacaacacacacacagaccaacgcacgcaccaccaagcaacaaaggaaacagagacaccacacaccaac

SEQ ID NO: 432698 - DNA, 2893 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432699 - DNA, 2870 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432700 - DNA, 3947 bp, Homo sapiens
aaataatgaaaattgacttctcatggttttggtgcctgggaagtccaagatcaagaggcaggcatctggcaagggccttcttgctgtgtccttttgtggtggatgggcaaagagacgagagagaggcaaaggggggccagaactcatttttttaaataaggaaccctcttccctgatgatgacattaatccattcatgagggcagagtcctcaaggcccaatagtctcctaaagatctaacctctcaatactattagaatggtgattaagttcaatacatgcttttttggggaacataatcaaaccatatgtctatcagtctttaatattaagatgtcttttttttctgaacccattttttgtgagatttagtgaatctttctgagtatcatatttgagagacaattgctttagccttatttttaattacttagctagcatgtaagctataaaagatataactaaatacttgactctgtgctgtcaaatgtcaaatgttgatttttaaaaattcatataattctaaacttttaacaaaattactgaagcaaagctctcatatttgtctctcattcttattgtataaaaattctaagcacataactgtcccctttattgtataattccaactacataactgtcctattattacttacctgacatcacattcccagtcattgtcacagctcctgaatcttgttccatttcttccacaagcaggctaattttaccccttcttcagtgacagaagaggcctgggctatggctgagcctaaatatatttgctatttcaggtgacatttagtgatgtggctatagacttctctcatgaagagtgggcatgcctagattctgctcagagggacttatacaaggatgtgatggtccagaattatgagaacctggtctctgtaggtaaggatatcaccccttccactccaataggggacacctttcttttgccaccctgaattgctggagattctcctaagtaaatggctgaattctgtaccatgctcccgaggaaatgtgcagctctgttgtgccctgcctaaagcttatctttccatttcagtgaacacccttcatccattcctgtggtccctcttgtgatggcctctcataatagaggaccacagcttaaacaattctatatttttcctgtaagcaggtctgtctttccgtaactaagccatatgtgatcatgttattggaggatggaaaagagccctggatgatggagaaaaaactgtcaaaaggtatgattccacatgagtcatggtgaacgagacaaaggaagattttgttaaagatgtttatagtgagtgtggaagcattttagggatactgtcttcaaagatctcagatagaaatgaaaaattgagggatatttagcttagattttcaaaacaattgttcctccctctcaaattattatctgtatcactcatgtcacctaatcaaggttagaggtttttgccatcataataattcaaattgttactatattcatgacaaagtaagacaatttattctttcttaattctacttaagaaaaatatactaatagttttaagctaagaaaagctgtcagttagatggaaaatcacttttctaaagctgagctttgtagatgaaatatgaacatattagaggaagtaagggacatataaatgtttctaggaataatattttctaatgttcaagaaaaatatgattcacacagtttcttcataacctcagaaagcctatatctttgtcagctataaagagcatttactttgtttttactgcagttgtttaatatagtagtatcaattctgtattttaagcttgataatccagcagcaaattgagattaatggaaggttggaaaaaaaggctatgaaacaaaatgcaacctttcccacatgaatataggcacaaaatgatgatttgtaatcctgaatgccttccacatcttatttctgatactttccttttttccatactattttatccatttcgtacagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtaggagtttgcaggagattcctattgcctatagtctttcccacatatgctacatgtagtcgacg

SEQ ID NO: 432701 - DNA, 2535 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432702 - DNA, 1657 bp, Homo sapiens
aaataatgaaaattgacttctcatggttttggtgcctgggaagtccaagatcaagaggcaggcatctggcaagggccttcttgctgtgtccttttgtggtggatgggcaaagagacgagagagaggcaaaggggggccagaactcatttttttaaataaggaaccctcttccctgatgatgacattaatccattcatgagggcagagtcctcaaggcccaatagtctcctaaagatctaacctctcaatactattagaatggtgattaagttcaatacatgcttttttggggaacataatcaaaccatatgtctatcagtctttaatattaagatgtcttttttttctgaacccattttttgtgagatttagtgaatctttctgagtatcatatttgagagacaattgctttagccttatttttaattacttagctagcatgtaagctataaaagatataactaaatacttgactctgtgctgtcaaatgtcaaatgttgatttttaaaaattcatataattctaaacttttaacaaaattactgaagcaaagctctcatatttgtctctcattcttattgtataaaaattctaagcacataactgtcccctttattgtataattccaactacataactgtcctattattacttacctgacatcacattcccagtcattgtcacagctcctgaatcttgttccatttcttccacaagcaggctaattttaccccttcttcagtgacagaagaggcctgggctatggctgagcctaaatatatttgctatttcaggtgacatttagtgatgtggctatagacttctctcatgaagagtgggcatgcctagattctgctcagagggacttatacaaggatgtgatggtccagaattatgagaacctggtctctgtaggtaaggatatcaccccttccactccaataggggacacctttcttttgccaccctgaattgctggagattctcctaagtaaatggctgaattctgtaccatgctcccgaggaaatgtgcagctctgttgtgccctgcctaaagcttatctttccatttcagtgaacacccttcatccattcctgtggtccctcttgtgatggcctctcataatagaggaccacagcttaaacaattctatatttttcctgtaagcaggtctgtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagtgctgggattacaggcatgagccaccacgcctggctaattttttgtatttttagtagagacagggtttcaccatgttggcctggctggtcttgaacttttgacctcacgtgaccgcccgcctcagcctcccatagtgctgggattacaggtgtgagccaccgcacccggccttggttgacttttgaggcccgaacattcttagttgtgggggaggaggtggaggttgcagtgagccgagatggcgctaccgcactccagactgggtgacaccccaaacctccatctcaaaaaaaa

SEQ ID NO: 432703 - DNA, 789 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagtttttttgggttatgtcgtcatgaagccggcgctttcagttgtgcaaccttgaacaaatgggttcagtatctcggaatttcagttttgtcttcattttaaaaaataaatctggtttagaactcgacctcaagcgatccgcccgcctccgccttccgaagtgctgggattaaaggcgtaagccaccgcaccagcctaacgaacatggcgaaacgccgtctctactaaaaatacaaaaaaaaattagctgggcgtggtggcacgtgtctataatcccagctattcgagaggttgaggtaggagaatcgcttcaacccgggaggcagaggttgcagtgagtcgaggtcgctccattgcactccagcctggagacagaacgagactccgtctcaaaaaa

SEQ ID NO: 432704 - DNA, 3117 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagtttttttgggttatgtcgtcatgaagccggcgctttcagttgtgcaaccttgaacaaatgggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432705 - DNA, 4262 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggcaagtgtgggtcgcggcgacggcggggctaaggccctgggtccgcgcgcggtttgaccacggccggggccttgggcatttcctggccttcctgttgagccgtgtaaacgcggggtgatgacggcgccgacctcttggcactgttgtgagagcgaagtgggcgcgagagcagacgccagctacagtttttttgggttatgtcgtcatgaagccggcgctttcagttgtgcaaccttgaacaaatgggacactgcccatctctaagataagaacctggaaaggggactctgttggccattggaaattgcagaataatgtctcagcgtcagtacccagagtgttacctggcaccaaatggatgcttagtaagtaattgtggagtgaataagatgagtaatgaagaactggtggggcagaatcatggcatggaaggtgaagcttgcacaggaggggatgtgacatttagtgatgtggctatagacttctctcatgaagagtgggcatgcctagattctgctcagagggacttatacaaggatgtgatggtccagaattatgagaacctggtctctgtaggtaaggatatcaccccttccactccaataggggacacctttcttttgccaccctgaattgctggagattctcctaagtaaatggctgaattctgtaccatgctcccgaggaaatgtgcagctctgttgtgccctgcctaaagcttatctttccatttcagtgaacacccttcatccattcctgtggtccctcttgtgatggcctctcataatagaggaccacagcttaaacaattctatatttttcctgtaagcaggtctgtctttccgtaactaagccatatgtgatcatgttattggaggatggaaaagagccctggatgatggagaaaaaactgtcaaaaggtatgattccacatgagtcatggtgaacgagacaaaggaagattttgttaaagatgtttatagtgagtgtggaagcattttagggatactgtcttcaaagatctcagatagaaatgaaaaattgagggatatttagcttagattttcaaaacaattgttcctccctctcaaattattatctgtatcactcatgtcacctaatcaaggttagaggtttttgccatcataataattcaaattgttactatattcatgacaaagtaagacaatttattctttcttaattctacttaagaaaaatatactaatagttttaagctaagaaaagctgtcagttagatggaaaatcacttttctaaagctgagctttgtagatgaaatatgaacatattagaggaagtaagggacatataaatgtttctaggaataatattttctaatgttcaagaaaaatatgattcacacagtttcttcataacctcagaaagcctatatctttgtcagctataaagagcatttactttgtttttactgcagttgtttaatatagtagtatcaattctgtattttaagcttgataatccagcagcaaattgagattaatggaaggttggaaaaaaaggctatgaaacaaaatgcaacctttcccacatgaatataggcacaaaatgatgatttgtaatcctgaatgccttccacatcttatttctgatactttccttttttccatactattttatccatttcgtacagcttacccatttcctttatcacactctgttcctgcttctgtgaactttggattctctgctctatttgagcattgttcagaagtcactgaaatatttgagttgtcagaactatgtgttttctgggtgcttcatttcttatccaattctcctaattccactgtagaagcttttttcaagaagtaaaaaaaaaaaaaaaaaaaaaaaaaaaaggcagtgctttgctttcttgatatatttcagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432706 - DNA, 2609 bp, Homo sapiens
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatca

SEQ ID NO: 432707 - DNA, 1005 bp, Homo sapiens
  misc_feature (874)..(874): n is a, c, g, or t
  misc_feature (880)..(880): n is a, c, g, or t
aatgtggttcgccgtgggcggtgcagctgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaantgagantcatacagagagaagcctatgatgtctgaatgtggaagactttagcatggtcatccttcacgacttcgataagccatatgagagaacctacaatgcttgatgttggaagccttacccttgttata

SEQ ID NO: 432708 - DNA, 3380 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432709 - DNA, 3467 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432710 - DNA, 3600 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacagtgcgtgggggcgctggactaccaggtcctcaggctgtggcgggttccccagactccctccaccaagccccaccccaacccctttccctgccaagagcttctcttgtgaagatgtaggggtcttggcctggcctagttgctgaggagtcatatcgggggtgcaggaggcgctggcccagggcacccagctttggttcctgctgtttttcctcctgtgcagatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432711 - DNA, 3687 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacagtgcgtgggggcgctggactaccaggtcctcaggctgtggcgggttccccagactccctccaccaagccccaccccaacccctttccctgccaagagcttctcttgtgaagatgtaggggtcttggcctggcctagttgctgaggagtcatatcgggggtgcaggaggcgctggcccagggcacccagctttggttcctgctgtttttcctcctgtgcagatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432712 - DNA, 3512 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacagtgcgtgggggcgctggactaccagatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggagctttggtgtcccctcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432713 - DNA, 3612 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaagtgagtgtggaaaaggggttggaggagagccctggagtggggggacccagcccagcatcagggggggtccttacagggaaccctaaaggacaaagaacctcaggggctcaggtccttccccaaagagggtggtctgggagctgctgagagacaggtcagaggcttccaccgtggctgcagccagaagggcctggagctgcccctgctccccactcctggccatgtccccagttgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432714 - DNA, 3537 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagagggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgaggggctgccctgtttgcaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432715 - DNA, 3310 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggagctttggtgtcccctcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaacccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432716 - DNA, 3536 bp, Homo sapiens
  misc_feature (1557)..(1557): n is a, c, g, or t
  misc_feature (3403)..(3403): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaaaaaaaaaaaaaataaataaattnaaataatttttatttaaaaatcctcgggggggggcccggcacccaattcccctttagtgagtggttttacccgccctcactggccgtcgtttaacaacttttggatgggaaaaccctgggtgtccccaactta

SEQ ID NO: 432717 - DNA, 3752 bp, Homo sapiens
  misc_feature (1557)..(1557): n is a, c, g, or t
  misc_feature (3748)..(3748): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagagggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgaggggctgccctgtttgcaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaattgagaaagcacctacctgtcttctgtgcagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacagaaaaaaaaaaaacaaaaaacaaaanaaaa

SEQ ID NO: 432718 - DNA, 3626 bp, Homo sapiens
  misc_feature (1557)..(1557): n is a, c, g, or t
  misc_feature (3622)..(3622): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagagggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgaggggctgccctgtttgcaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaagtctttgacgaacaaacaaacaaaacaacacaaaaacacacaaaaacacacaaaacaacaaaaaaaaaaaaacaaaaaacaaaanaaaa

SEQ ID NO: 432719 - DNA, 3292 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccaagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432720 - DNA, 3138 bp, Homo sapiens
  misc_feature (1557)..(1557): n is a, c, g, or t
  misc_feature (3134)..(3134): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacagaaaaaaaaaaaacaaaaaacaaaanaaaa

SEQ ID NO: 432721 - DNA, 3340 bp, Homo sapiens
  misc_feature (1557)..(1557): n is a, c, g, or t
  misc_feature (3336)..(3336): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacagtgcgtgggggcgctggactaccaggtcctcaggctgtggcgggttccccagactccctccaccaagccccaccccaacccctttccctgccaagagcttctcttgtgaagatgtaggggtcttggcctggcctagttgctgaggagtcatatcgggggtgcaggaggcgctggcccagggcacccagctttggttcctgctgtttttcctcctgtgcagatcgtgtctcagaaggacgagcactgctgggtgggggagctcaacggcctgcgaggtggggtccttggtctgctcttgagctgggagagggaggagggggtgggcacagaagacttgggtgaccctggccgccaccaagctgttctcctctatacacctgcctggcttgaggtccctgaagcagctgagccggcttcccactgcctcagcctgcctgcaggctgtgtctgctctgtcctcggccctcgtggttgctccttacagggcctgtttttcccacaggctggtttccagccaagttcgtggaagtcctggatgagcgcagcaaagagtccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaattgagaaagcacctacctgtcttctgtgcagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacagaaaaaaaaaaaacaaaaaacaaaanaaaa

SEQ ID NO: 432722 - DNA, 3040 bp, Homo sapiens
  misc_feature (1557)..(1557): n is a, c, g, or t
  misc_feature (3036)..(3036): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggacctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaattgagaaagcacctacctgtcttctgtgcagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacagaaaaaaaaaaaacaaaaaacaaaanaaaa

SEQ ID NO: 432723 - DNA, 1199 bp, Homo sapiens
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcaggtgaggccggtggcactgtgcaggaagagctggaggctgtgtgggctcgcaggagagagggagcctgcctggggttcttagagtgtgcccttgatgtggggtaggggaggatatttgctccttccttggtcctctgcaggccaaagaaagaattgtccaaaaggccatcagtgctgtggaagggcttggagatggggttcccaagcccgggtccacttcaggaacagatggggactctaaatatagactccaggcctcgggccacacgttttcaggtggtctggcatgaagtttcccagctggatttgatgtcccggctccacactggctgggagctgaccctgaagggaggagggtgaccttgatcaggaacacaaggaatccccatttctgggggagaagcccgcctggggtctgcctccctcc

SEQ ID NO: 432724 - DNA, 438 bp, Homo sapiens
cagggctttctcagacccatccctcccatcagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggtaagtcagtggctgggcccatgacccccaccctgcaccagccctgctgtgccccctagtacccatcttaggtccttcctgccccacagagaggatgggaagagctggcagcgtggtgacaggtgcccagtcggccccaagggctttgaaccagcatcttcctgtccctgcactcacaccgtgtgctgtccccacaggctgcaggccgggaggtcgagagagactttgcctccgtgtattcccgtctggtgct

SEQ ID NO: 432725 - DNA, 3626 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagagggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgaggggctgccctgtttgcaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggcaacatctttggtgccaatatttatacagaaaaagaggacagtggttttatgagataatggggttctagtcttaggaggggaacatgcacctagaccttgttgggtgcatgcggtattgcattctgaaacagtccacgtttata

SEQ ID NO: 432726 - DNA, 2951 bp, Homo sapiens
  misc_feature (1557)..(1557): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccggtccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaa

SEQ ID NO: 432727 - DNA, 2980 bp, Homo sapiens
  misc_feature (1557)..(1557): n is a, c, g, or t
  misc_feature (2976)..(2976): n is a, c, g, or t
gcttaggcgccgctgagcgctgactgggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacaggtaaggtggccacagggacccacagggtgttgagagggtcctggccccatgatcaggtgtcacgagaaagactgagtgcccttgcggctcccttccctcagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcncgggggctgcggaaaacaaaccagcccttcctgctctgccccccagcctggcccagtcagaccacagctgtggggtgatccaggcctcctcaggctttgtgcacctcaggttctgatcctggcacggtttgggaggaaggcagacccagctctgattatctgttttcaattcttggagccagcgtcagaggctatttcagatgagacagtataagccaagggctggtgggttctcttcctcccggggccaggaccaccctgacccactcctcttggtgcaggttgttcgccgcaggacccagcggaggaagtccaccatcactgctctgctcttcggtgagagctctgcgagtgccaggcagtgtgggcatgcgggagtctgtcctcacgctcatgtggacgtggagcttcctcctcgggggcctggagtgggctgtggtcaccatggttctctgggcctcctaggggaggatgacctggaggcactcaaggccaagaacatcaagcagacggaactggtggctgacctccgggaagccatcctgcgcgtggcacgccacttccagtgcacagaccccaaaaactgcagcgtggtggtgagtcgccagctccctgggctgctaccaaacacggccctaactcctccaacccccttggtgggcctgtgttcactgtggcaggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaattgagaaagcacctacctgtcttctgtgcagctagggctgcagagctgtattcaggtccaaggttctgcccttccttgagtggtctagaaggcactgcgtggcccctcagatgctgggacacaacagacccgggacccagctgtgctacccaccccttccatggactgaataagatggactaacagaaaaaaaaaaaacaaaaaacaaaanaaaa

SEQ ID NO: 432728 - DNA, 1678 bp, Homo sapiens
tgatagtaatatttcttaccaatggtaaaatttgaacttttaagcaaaaattagaattttggaaaactcatttgccaccgtgatcttggcagcttttgaataagagttttctgatgggtggtggtgttcataaataatgatttttaaaatattgtgtaatgaactatgtcaccatttggaagacctgtgtaattcagtgaaactagtattttccacataactagtatatatactacaaaagtatgcatgggtaaaacatacatttaaaagctaagatagaccaatgattttaatggaacgggtgttctgggatacggtttcagatttcacactgcaacaaacctttaagaaagtaccaactgttcagttttggtatagtatcaaagtagtatatcccacagttaattaaaacccctattaaaacactcccttttcccagttatatattcctgtgaggcagaatttaataatactcctcaaccaaaacaacatgtcatagtagactgaaggcagaagcagataagagactaaaacaatttttgattaagctagatatttaagagctttgcaaagatgtgaaacaatgccacttttcactagttttttttgcgtttgcaagtcatttttcattaaaatgttatttatgttaatttgtaatgagtttgttattttaaaatgaataaataaatattataaaatattctctgttttaatttctaatatggaaaatattgatagatataaccaatgtgaacaaaaagtctttttgggttcaacaatttttaagtgcataagatgattctgaagccaaagagttagggcaccactgtctcagaaaaatagtagtacattttcctaaaaatgtatattgtttaaataataagaacaataagggagactgctgagtctctatcttcaatcatctaaggttctacaggctatttctaatgttttaaaaaatgtaacaggtggctgggcgtggtggctcacgcctgtagtcccagcactttgggaggccgaggcgagtggatcacctgaggtcaggagtttgagaccagcctggccaacagggcaaaaccctgtctctactaaaaataaaaaagttagctgggcatggtggtgggcgcctgtaatcccagctacttgggaggctgaggcaggagaatcacttgaacctgggaggcggaggttgcagtgagctaagatcctgccactgcactccagcctgggtgacagagtgagactccatctcaaaaaaaaaaaagtaataggtgttcctgaaggtatagcgggaaaggtacccagaatgtaaaaattctttgctattagttggaatcaaattaacttagtggtttcttttatgcttattataagctgtttggcatttgagggaaaaaaatagaaaaacaaaacattatttaatagttcgttaggtaaaaatctttccaacgtttgaccgaggatggggaaaaaaaataaaagcaagagtttgtacgtttggtgttataagagttaggaattagattcctttctgactcagaatgttttgggcatagtttttaaatcaaagcacctcagctgatggttcccagtacttgggttcttttaaaaaatgagaggttttgccagttggtctgggtggaacccagaaatgatagctgcttaaaaactcttcaag

SEQ ID NO: 432729 - DNA, 1110 bp, Homo sapiens
ctgttgactttttatatggaacccaaatcagattgaagaagtttctttctcttctgagattgcaaaaagtttttgtcaaaggaaaacagcctgttcatttcatggaaggacgttttggaaaaatagatccagacctacatagaaagaaagatttgagtgcacactacatacattagaagagaaaaataaaggaaaatcagactgctatgaaaaccaagtttcccacttcatgctaaaaagtggtaacattgcatgtcagactgaagaaagacacctgagtctatgttgagttgtgtttggccccttgcaaggttgtcataaatgattcattgttttggcttaaggggctttcagctggatgacaaagcataaggacaaaaaatatgaaatttgtcattaaatgtcttcatcatttagcctgtttaattgtgctaagatcttttaagaaacaatgaatacagagatttccagattatacttccatgaaagcctaaatcttctcaggtattcacagtttaaaaaaattgaagtataccaaatgatatccaagtttactgtgaaagcaaatggcccataaaattttgcatttacatttgaattttaatctagagagaaggagaccacataagtaaaacacaatctatctcataggctgaagcgtcaggtattacaaatgtatgtggttagcttctctttatttagttctcattgatttaggtactaattctacccattctttgctttaatcatttagtattaagaaatattgactttcatcagagcttaatatacaactggctccaaatctagaaaatcaatttaaattctttatagtagtatgtaattggttaattcagtcatttttaaaacaatatatttgtttaaaaatatttattttgctaaccagctaccagacattgttctaggtaattcttacagaagtgcgtaagacagatagtgtggcttcccacatagggcatatagattacaaagagaagacatagctaaagaattaaaccaataataaaaacatcaaattctctgaaaaaaagagctgctgccagtatcagtgaatacttctttcatgtaacacaaactgacacttaaaga

SEQ ID NO: 432730 - DNA, 1312 bp, Homo sapiens
ctgttgactttttatatggaacccaaatcagattgaagaagtttctttctcttctgagattgcaaaaagtttttgtcaaaggaaaacagcctgttcatttcatggaaggacgttttggaaaaatagatccagacctacatagaaaggtatgacagctaccttaattcatccatcaagacctttcttcttaattgtgaattaccaactatagatcatcagagaatttaagaaaatcgacaaactaaatgcaaagaaacaagctaatgaaatagaacaaatgactaaaggaaacagaagtaattcaatgaacataagaaaacttaaaaaatattctaattacattctcagaaagatttgagtgcacactacatacattagaagagaaaaataaaggaaaatcagactgctatgaaaaccaagtttcccacttcatgctaaaaagtggtaacattgcatgtcagactgaagaaagacacctgagtctatgttgagttgtgtttggccccttgcaaggttgtcataaatgattcattgttttggcttaaggggctttcagctggatgacaaagcataaggacaaaaaatatgaaatttgtcattaaatgtcttcatcatttagcctgtttaattgtgctaagatcttttaagaaacaatgaatacagagatttccagattatacttccatgaaagcctaaatcttctcaggtattcacagtttaaaaaaattgaagtataccaaatgatatccaagtttactgtgaaagcaaatggcccataaaattttgcatttacatttgaattttaatctagagagaaggagaccacataagtaaaacacaatctatctcataggctgaagcgtcaggtattacaaatgtatgtggttagcttctctttatttagttctcattgatttaggtactaattctacccattctttgctttaatcatttagtattaagaaatattgactttcatcagagcttaatatacaactggctccaaatctagaaaatcaatttaaattctttatagtagtatgtaattggttaattcagtcatttttaaaacaatatatttgtttaaaaatatttattttgctaaccagctaccagacattgttctaggtaattcttacagaagtgcgtaagacagatagtgtggcttcccacatagggcatatagattacaaagagaagacatagctaaagaattaaaccaataataaaaacatcaaattctctgaaaaaaagagctgctgccagtatcagtgaatacttctttcatgtaacacaaactgacacttaaaga

SEQ ID NO: 432731 - DNA, 613 bp, Homo sapiens
tatgatcattccctcgaaatgtggaaactattatgtatgtcagtatgctcctagtccggtcccttaagtattccttcacgtgtatgtaatgctaggattatttgctatgaatattatgtacggcgcaggtggactcgcacgacgttgacgtttaagctagatgtatgaggactaggacgattaatgtaggatcactatgaactgtaactcttactacagtatggtagttccacagcagaagttatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaaaaaagg

SEQ ID NO: 432732 - DNA, 559 bp, Homo sapiens
gatttctcttctttccccagttctccttggtctgtaacaggaatgccccttactcagtagcaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaaggtaagttctttcactaagaagtttatcttagcaacacagaaaatcttactgtattctgggaaaggttcacttcattttattccccaattgagagaactttagggaattattttccttttagaaagagagaatctaaccaatctctggtacattggaatgtatcttctctgtttgtttgtccttgccaaagctttcttctcacccctttgttttgaaaaatccatttttggaactgcttttaaaagcataggtctggccaagcatggtagctcacgcctataatcccagca

SEQ ID NO: 432733 - DNA, 4441 bp, Homo sapiens
accggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagaaacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagtctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacataatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaagggcatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaaaaaagg

SEQ ID NO: 432734 - DNA, 2519 bp, Homo sapiens
aacaaaagcagcttgattttattgcagggaagctaggaaggaataggacaactgagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagtctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacataatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaagggcatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaaaaaagg

SEQ ID NO: 432735 - DNA, 2472 bp, Homo sapiens
  misc_feature (2339)..(2339): n is a, c, g, or t
  misc_feature (2349)..(2349): n is a, c, g, or t
accggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagaaacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaagacaccagaaggatgaagcacaaaaggantttacagccnttcttttcgtctttggaacggaggagacttgctgatgatatcaaccaaaaagatggtcctggggaggcttctgcatggcgaattttgagagcaaaactgccaattaacaactgctctaccgaa

SEQ ID NO: 432736 - DNA, 2838 bp, Homo sapiens
gtacattatttcattttggaacaagtaggtgttaaaaagaaacaaaatgcttctgctgttgttgggggtgcagtttgaacaaaatctgttagataatcacctatagtttgcttgtgatttataaattttggactacgcacatatatatatattttaatgttttggattgtgttgcacttctttgttggagtgagagttgattagctctcttaactgttgcacatatttatttaaactagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagtctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacataatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaagggcatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaaaaaagg

SEQ ID NO: 432737 - DNA, 901 bp, Homo sapiens
accggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtggttagttacttctaatacaaattttaaatagtgatttaaaagaggtattttatgtcaacattgaattgcttga

SEQ ID NO: 432738 - DNA, 387 bp, Homo sapiens
tctagagacttgctacttgaagttgaagctgcagttaagtttatagggtgccaagtgctcatttaatcctctcaatagccctacaagaaaggtgttgtagcattccagatgaggaacagttgcacagagcagttaagtaagtttcccaagatcagaccactaataagtggcagagttaggatttgagcccaggaagtctggctccggagtccatgtctttaactgtcacactctgctggttgagaagctgagcaccaagctcctaaggaagaggccggctaagatgggcagagttcttatccatacctgcactcacaccctggcttcagactcccccaaaactgattcagcaaactaatctgaaagtagcttcctgtcacccaccca

SEQ ID NO: 432739 - DNA, 399 bp, Homo sapiens
  misc_feature (50)..(50): n is a, c, g, or t
cccccccccccccccaacttccacctcccaggttcaagcgattctcctgnctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 432740 - DNA, 294 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagaccaagcccaaggacataattgaatctggagagtcctggggccttgttttgaaaaagacttgaaatacacataggaagaaaggcataaaaataaatgttcacttgtctctgctgtga

SEQ ID NO: 432741 - DNA, 492 bp, Homo sapiens
gcggccgcctactactactactgctcgaattcaagcttctaagatgtacggggacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgcacttatatgtatgtaccatgacataactaattcgttgaacaagttgtgagacaatcctttctgagaaaaggtagacctgttacatcgtctgtgggttagggtcatgtcagcacgtaccaggtacattctagcttttgtagagaaagtaaaatctagtgttgagtatgtaggcactgagccaggtggcctgcttaacataaaaggactgatttcagggtggctgtgggagcctttctaatgctctaattctctagccccttgcctga

SEQ ID NO: 432742 - DNA, 4426 bp, Homo sapiens
  misc_feature (2)..(2): n is a, c, g, or t
  misc_feature (2979)..(2979): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432743 - DNA, 4702 bp, Homo sapiens
  misc_feature (2)..(2): n is a, c, g, or t
  misc_feature (2979)..(2979): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgcacttatatgtatgtaccatgacataactaattcgttgaacaagttgtgagacaatcctttctgagaaaaggtagacctgttacatcgtctgtgggttagggtcatgtcagcacgtaccaggtacattctagcttttgtagagaaagtaaaatctagtgttgagtatgtaggcactgagccaggtggcctgcttaacataaaaggactgatttcagggtggctgtgggagcctttctaatgctctaattctctagccccttgcctga

SEQ ID NO: 432744 - DNA, 4320 bp, Homo sapiens
  misc_feature (2)..(2): n is a, c, g, or t
  misc_feature (2873)..(2873): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432745 - DNA, 4283 bp, Homo sapiens
  misc_feature (2)..(2): n is a, c, g, or t
  misc_feature (2836)..(2836): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcaggggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432746 - DNA, 4542 bp, Homo sapiens
  misc_feature (2)..(2): n is a, c, g, or t
  misc_feature (3095)..(3095): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggaggtaatggtggggaaccaagagaaagtaattagaatttttatttggtgagttttatcccgcatgtgttggactacatttggtattgacgagctccccccaacggtttgacagaccagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432747 - DNA, 4408 bp, Homo sapiens
  misc_feature (2)..(2): n is a, c, g, or t
  misc_feature (2979)..(2979): n is a, c, g, or t
  misc_feature (4396)..(4396): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagatgaaccacgtgacgaaatagaaaaagctacctatggagttgtgcccctactgccntgccatatgcaa

SEQ ID NO: 432748 - DNA, 4393 bp, Homo sapiens
  misc_feature (2946)..(2946): n is a, c, g, or t
atcacccaaaccagaaacctgtggattttgcatgtttatgagctctgtcctttgtagccctctaccactgctcatatttttcctgaactattgtattaaccttcctcctggatttccttgcctctagtgtcatactgtgatctgtcccatacactgcccttggtgattgtcagaaagaaatctggtctggtctcttctgcttaaaatcttcagtagcttttactgcccatagaagcacatccagcttccttagctggacatgtgtagacctacataccaccactccgcctacccctgaaacacacacaagttcaatttccatagcattccaggcactgctccacattatgaaaaggatctgttttcataaccgcctcccactaaactgagctctttaaggcatagtctctgtgtcttattccagattacccagtgtagtgacctcgcatgttgtgcttgctggactgacataaactggagggagtctgtctgacttctgttgctgttcatttcaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432749 - DNA, 4598 bp, Homo sapiens
  misc_feature (2)..(2): n is a, c, g, or t
  misc_feature (3151)..(3151): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctgggtgagtgctacagcttaggggtcagctggggcagaaagccagggtctttgaagctttgatgtgagattcaggttgtattcttcttggggccccaagagtctgccagagtggccagcttagtatatgctggatacatgttaaataaaggaatctgtgcttttgtgtttcttagggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432750 - DNA, 4565 bp, Homo sapiens
  misc_feature (3118)..(3118): n is a, c, g, or t
atcacccaaaccagaaacctgtggattttgcatgtttatgagctctgtcctttgtagccctctaccactgctcatatttttcctgaactattgtattaaccttcctcctggatttccttgcctctagtgtcatactgtgatctgtcccatacactgcccttggtgattgtcagaaagaaatctggtctggtctcttctgcttaaaatcttcagtagcttttactgcccatagaagcacatccagcttccttagctggacatgtgtagacctacataccaccactccgcctacccctgaaacacacacaagttcaatttccatagcattccaggcactgctccacattatgaaaaggatctgttttcataaccgcctcccactaaactgagctctttaaggcatagtctctgtgtcttattccagattacccagtgtagtgacctcgcatgttgtgcttgctggactgacataaactggagggagtctgtctgacttctgttgctgttcatttcaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctgggtgagtgctacagcttaggggtcagctggggcagaaagccagggtctttgaagctttgatgtgagattcaggttgtattcttcttggggccccaagagtctgccagagtggccagcttagtatatgctggatacatgttaaataaaggaatctgtgcttttgtgtttcttagggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432751 - DNA, 4145 bp, Homo sapiens
  misc_feature (2698)..(2698): n is a, c, g, or t
cctggtgaacatttacatccataaatttaaatttctaattatgtaagtggggtcacttcagttctttatcaggagtatttccaagcatttcagctggaatgtgattgcagaacacttgctcgttgggagaagtgagtgtgtgggagaacctctccaacctctcagccaggctgcaggactggtatgtagtgtgccaggtgctggtgaaaaccgtgctttattttcctacatagatttccaaatctgaagtctgtccgagaactcattttgaaacgtggacaagccaaggtcaagaataagaccatccctctgacagacaatacagtgattgaggagcacctgggtgagtgctacagcttaggggtcagctggggcagaaagccagggtctttgaagctttgatgtgagattcaggttgtattcttcttggggccccaagagtctgccagagtggccagcttagtatatgctggatacatgttaaataaaggaatctgtgcttttgtgtttcttagggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432752 - DNA, 3735 bp, Homo sapiens
  misc_feature (2)..(2): n is a, c, g, or t
  misc_feature (2288)..(2288): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432753 - DNA, 3338 bp, Homo sapiens
  misc_feature (2)..(2): n is a, c, g, or t
  misc_feature (1891)..(1891): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacagggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432754 - DNA, 4375 bp, Homo sapiens
  misc_feature (2)..(2): n is a, c, g, or t
  misc_feature (2979)..(2979): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432755 - DNA, 4185 bp, Homo sapiens
  misc_feature (2)..(2): n is a, c, g, or t
  misc_feature (2979)..(2979): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432756 - DNA, 3308 bp, Homo sapiens
  misc_feature (2)..(2): n is a, c, g, or t
  misc_feature (1861)..(1861): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccgggggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432757 - DNA, 2646 bp, Homo sapiens
  misc_feature (1199)..(1199): n is a, c, g, or t
gcgtggtcgcggccgaggtacgcggggagatgtaactgccttaaaacatgccagcttaggctgggcactcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432758 - DNA, 3553 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtgttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432759 - DNA, 2711 bp, Homo sapiens
  misc_feature (2)..(2): n is a, c, g, or t
  misc_feature (1264)..(1264): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattggggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432760 - DNA, 3411 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtgttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432761 - DNA, 2575 bp, Homo sapiens
  misc_feature (2)..(2): n is a, c, g, or t
  misc_feature (1128)..(1128): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggaggccaggctggtctcgaactcctgacctcaagtgatccacaagcctgggcctcccaaagtgctgggattacaggcntgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacgcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432762 - DNA, 3492 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtgttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432763 - DNA, 3253 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagataccttaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttaca

SEQ ID NO: 432764 - DNA, 3086 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggctttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcgtgatctcggctcattgcagcctccacctcctgggttcaagtgattctgcctcagccccttgatcagctgggattgcatgcatgtaccaccacacccggctaattcttgtatttttagtagagatggagacagagtttcaccatgtgttcgagaccagcctgaccaacatggagaaattctgtccctactgaaaatacaaaattagccggatgtggtggtgcatgcctggaccctgcctctgagaaggctgacgctgtatatttaaatgagaccaaatgctcatgtattctttcattcagctaacaaactagaaaaagttatggtcattt

SEQ ID NO: 432765 - DNA, 2469 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 432766 - DNA, 2321 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaaaaaaaaaaagaaaagacagtagcatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 432767 - DNA, 990 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggttacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctc

SEQ ID NO: 432768 - DNA, 1121 bp, Homo sapiens
  misc_feature (2)..(2): n is a, c, g, or t
gnccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctgggggtaagtaaggttttccatgtgaattcacattagatttctatttgagtgtgtcagggtgcaccgggtattgctttccagggctcatgttgctgtagaagggacattttgctgtgaccacagtcaacctgaaatcagtgggtagctgtaataaccatgggacacagggtagggaggggtctgaacaataccatagtagggctggttcagtcataggctaaggctgggtcaaggaaagcttggttcttgaaagtcttaaagcagagctaaaggcagtgcatgtgtaagagtagtattcctggccggacacactggctcatgcctgtaatcccaacactttgggaggccgaggcgggtggatcacacggtcaggagtggatcacagggtcaggagattgagaccatcctggccaacatggtgaaacccctgtctctact

SEQ ID NO: 432769 - DNA, 592 bp, Homo sapiens
tgcggccgctccaacatcagaatggtaacactgtacccatatttagtgtaagacagagctgggatataagccttgggcttccactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgcacttatatgtatgtaccatgacataactaattcgttgaacaagttgtgagacaatcctttctgagaaaaggtagacctgttacatcgtctgtgggttagggtcatgtcagcacgtaccaggtacattctagcttttgtagagaaagtaaaatctagtgttgagtatgtaggcactgagccaggtggcctgcttaacataaaaggactgatttcagggtggctgtgggagcctttctaatgctctaattctctagccccttgcctga

SEQ ID NO: 432770 - DNA, 942 bp, Homo sapiens
tggagtcccacgccggtggcggccgctctagaattagtgatccccccgggctgcaggaattcggcacgagctcgtgccgattcggcacgagcctcaccccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432771 - DNA, 7102 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432772 - DNA, 6904 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttcaaaaaaaaaaaaaaaaaaaaaaaaaaaaaaaaaaaaaaaaaaaaaaaacaaaaaaaaaaacacaacaaaacaacaaacaaaacaaaacaaaaaaagggggggcaggcgcgagcagcacccaagagagaagcttttaacaacaactctgttgtgggggcgcgggcgcaccaaagagagagacaagcagcgagaaaagaggagtagacagaaaagaaagacgtcgggggaagaacacagcgggggggaggactaccacacccaaaaagaaacagacagcgagcgcacggggagaaaaaaagaacaaggtagtataagagaaaaaacaaccacaagaaaaggaggagttgataaaggagaggacaaacaaagaggactttaaacaaaggaaggagaccatcacagcaggacaagcaaacataagaaaataacgccacccccgcagaggggc

SEQ ID NO: 432773 - DNA, 6024 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttgga

SEQ ID NO: 432774 - DNA, 7055 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgctccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432775 - DNA, 6891 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432776 - DNA, 7048 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagacagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432777 - DNA, 6836 bp, Homo sapiens
tgcatctgcagtgtgacctagagtgatcccagattaaacttatagactgagtctttgatatgacacacatgtcacaaagaggcgactcagtatatacaggctgagaacttatatccgactgcatcgcccgctttgtcctcgcttggcggccctgcccgcttcaggccatccctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432778 - DNA, 6550 bp, Homo sapiens
atcctcccattctttgccaccacagtcaggcatcccagcacttacccccaccccctggggcttcctcccctgcctcttcctgtaccaggcaggtgtatgagagaggatctacaggaagccttccagactgggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432779 - DNA, 6683 bp, Homo sapiens
agccgggcgtggtggcgtgcgcctatagttccagctactcaggaggctgaggcaggaggatcacttgagcccaggaggtcaagtctacagtcagccgtgattgcaccactccattccagcttgggcgacagagcaagaccgtctcaaaaaaacaaaaacgaaagaaatgagagtgaggtggggctaagcactgcctagagtctgggatccggttcattgggagaaaccctgggtagtgaaagtgtggagtgctgtattcctctgttctcccctaagactggacccaaagatagtggtcagtgggagggggtggccagcctctttgagccatttcttcttcaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432780 - DNA, 6002 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgctgggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttgga

SEQ ID NO: 432781 - DNA, 6807 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432782 - DNA, 5959 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttgga

SEQ ID NO: 432783 - DNA, 6877 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgctccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432784 - DNA, 5846 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttgga

SEQ ID NO: 432785 - DNA, 4084 bp, Homo sapiens
tggctcacgcctgtaatcccagcactttgggaggccgaggcgggtggatcatgaggtcaggagattgagaccatcctggctaacacagtgaaaccccgtctctaacaaaaatacaaaaaattagccgggcatggtggcggatgcctgtagtcccagctactcgggaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432786 - DNA, 5330 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432787 - DNA, 5195 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggaggaaaccaaccatcaggcctcccagagagaatcgaggaactgaaatctcccatatcaccacatccagacaatgagacatggctgctgcctgttgacaaactcctcttctttatacctcccgaatttctgttttcctgcatatggttacggtgagacaccagacccctcatccaaccacctgctgcccgttgaccaactcctcttccttactcctccctaattcttgttttacgttccttccctactatataaacccctaactttagtcaattggagagatggatttgagactggtctcccatctcctggctgacattactggcattaaagctgttcttccctggca

SEQ ID NO: 432788 - DNA, 2443 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatatactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgatcctttgtgtctagcttctttcacttagcaaagtggtttcaagcccattaatggtcccatagtagttggaaagatctctcttctgagtcccaaagtctttaagatgagggtgctggactaaatcagggaccatcaacagattgtttacatgtttttgtgggtgtttgcatgcatgtgtttttctgacaagaagactaaccagcttgtatcagattcataaagggatccttgaccctcca

SEQ ID NO: 432789 - DNA, 3269 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaaggtgaggacgcttggagtgctgatgagggatcaaggggaccaggggacctgagcagcaggccatgcttggctcctttcaaaagcttaaagtgttcaggcaagacaggacacacgt

SEQ ID NO: 432790 - DNA, 2877 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaaacaggccgggctccttgctgctctccatgtcggcctgggcagcagccagccgcttctccaggctctcctcgccttcagtgttcgctgcgcagcgctgctacagctcgtgcagtgaaggcggctgcacgaaatatgtatag

SEQ ID NO: 432791 - DNA, 2173 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctgttctggggcacacataagatcctgagagtcacctaaact

SEQ ID NO: 432792 - DNA, 1577 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttgtaaggacccagccctgacttcttaatgctctgcttcttgtcccttcaataagcattcccctgcatggcactggaccagtt

SEQ ID NO: 432793 - DNA, 493 bp, Homo sapiens
tgggggtgttaagggggggcccagagaagggaaggggtaggctgctgacccactttgctcctgtcctgggtatggcagatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagaggg

SEQ ID NO: 432794 - DNA, 304 bp, Homo sapiens
ccaacatccaggctctcaaggaggctcttgctaaggcccgggcctggattgctgatgttgatgagatccaagtgaggaccctgccactcccaccccaggccttcagtccagctgggaagagatggcatatacactgggatgtgctgggttgctgggatgggttgggttggctggagagaggaagggggcatggcatgtagtcaggaggcaagatgtgcctgatgagcagggtgagaggaagagtgtgaggctggcctgaaggaagagagggcactggttaggatgagattggtgggccagggaa

SEQ ID NO: 432795 - DNA, 225 bp, Homo sapiens
gtgggggtgggtggttgggtaggatgtttgcaggttaaagggtctggagtggctagaggtttgggaaggtgccagtgggattccgagctgcttttggtgacttccggtcttacactatgctgagataactcaagtccctttcccctctctaccctctcaggactggcagccaccctttgctgtggaagtggacaacttcaggtttaccccccgaatccagaggct

SEQ ID NO: 432796 - DNA, 823 bp, Homo sapiens
atttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccat

SEQ ID NO: 432797 - DNA, 802 bp, Homo sapiens
tgccccgcgccgctcgaccgcaaagttcccgctgctcaccagccaggagtccctggcatttcattcagtgtcatacagccctcctgaaagggagcggctgcttccagctccctattcttttgaaagtgtgatttaatatgtcagtaattgatgatttttctgattcctgccttacttttacatggtgcttcttgttagaattatctttgtgatgtttattaatgactttgtattttatctgcacagctttaatttccaggtagaggctggaatcccttataatttagaggtatcttaaaaatggaatcattatgcagccctgcatcaaaaataaacattacagaagaaataaaatttagctccaagaaatataatattatgtagtacatgtattttaagctagtacatcgagtatgtggaaaaataaaaaatgtctcttttctgtatttcttctgggacttctgaacatttcatgcctatagagcttttaagcagcgacaggcactatttaattagaatttcaaccccaaaatatttatacccaaccaaatagaaaccattgtccagtaggctcctgttaatagtttctatctctaataggctaacaatcattggcatggcgggagataatctacggggtgctagcacttaagatagacaagcatttaaaaattgtaagaatccttaagatttttctgtttttaaaaaaaccttgatatctattataaaatatttagcctaaataaacgtctcctagaggttttaaacagtgcttttacaacttccttgtggcatggtggca

SEQ ID NO: 432798 - DNA, 4681 bp, Homo sapiens
ctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacattcgaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccaggtgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgccccgaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacgaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactatgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttca

SEQ ID NO: 432799 - DNA, 4999 bp, Homo sapiens
ctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacattcgaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccaggtgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgccccgaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacgaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactatgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtttttgtgctctttggttcttgttgtaggtattgactgtcctgggatatcactggtcatttaaattcaccatataattagccgggcatggtggcatgtggtggtggctgaggtgggaggatcgcttgaggctgaggtgtgaggctgcagtgaaccatgttcacaccactgtactctagcttgagcaacagagcaagaccctgtctcaaaagtaaataaataataaagtaaatataaatccatgatgccgttactcaggggtagacagactttctgtaaaaggccagataataaatctgctaggctttgcaaacc

SEQ ID NO: 432800 - DNA, 1591 bp, Homo sapiens
ctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacattcgaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagtaagcctgcacgtcattgtgtttttacaagtgggaagttggttctgcagttgggatagtctgtgggtacaagtgtagtcactttgactgctgtgagggaggatgccacagtgataggagacccttgggaggactctatctggcagggggctttgctgagtcacttcctttcctatttccccgtgtataggccagataggcccagtgtggtagctcatgcttgtaatcccagcactttgggaggccaagacaggtagactgtcaggtagactgtctgagcccaggagttcaagaccagcctgggcagcctggcaaaaccccatctctacaaaaaatacagaaattagtcaggcatggtgctgtgtgcctatagtcccagctgctcgggaggctgaggtgggaggatcacttgagcctgggaggttgaggctgcagtgagccatgactgcaccactgcattgcagcctgggcgacagagagaccctgtctcaaaagtaaaaaatgtaagcagctagcctgtgctcaggtgggtgggagatgccatgagagtgttaaagttcattactgccagagagacccgtatgacaagctgagtaagcaggatcctatgatgtggcgacccagaagttcagagc

SEQ ID NO: 432801 - DNA, 931 bp, Homo sapiens
ctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacattcgaagctgggtcttggtagatgaagtatttaaaagaagaggccatgatatagtaatatttggtttaatgtggtatggttgtagtgtgtggcggaaatttgagaggaagaattgtcaacttgcagggcagcagggaagccatttgtatttagctagaagaacatggattgaagcaatggatgatggatttcagagcaatttgtgaagtagaaccagaattttgtccgtcgaacttggggtgacgaagcactatgcctcagataaaggtactatcttctagggaattcaaacggacctaagctgctatttgggcagttgagaccaagagaggcatcctggtaatagtgctgtgcttcaagacaaaagacattaaaatatttttacattgcaaa

SEQ ID NO: 432802 - DNA, 1211 bp, Homo sapiens
ctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacattcggtaatgcattcatgtccatagcttttgtttttattcatctgaaaaaactgccatggtatgtggtgggaagggggacatggaatatgaggaagcgtttgaccatgtttaatatgttaccaaaattgagcacagctgaatggaacttaccttctgtacctaattttctatttttctttcttgttttttccatctagaaaatgttactacgattatggattttcttttttaaaaaatattcttttctggctgggcacagtggctcacgcttgtaatcccagcactttgggaggccagggtggatggatcacctgagcccaggagttcaagaccagcctgggcagcctggcaaaaccccatctctacaaaaaatacagaaattagtcaggcatggtgctgtgtgcctatagtcccagctgctcgggaggctgaggtgggaggatcacttgagcctgggaggttgaggctgcagtgagccatgactgcaccactgcattgcagcctgggcgacagagagaccctgtctcaaaagtaaaaaatgtaagcagctagcctgtgctcaggtgggtgggagatgccatgagagtgttaaagttcattactgccagagagacccgtatgacaagctgagtaagcaggatcctatgatgtggcgacccagaagttcagagc

SEQ ID NO: 432803 - DNA, 530 bp, Homo sapiens
ctcttccccatttcatttttttagtatgggtatggttcaacaacatatttgttgaaaagatatcggctcaggattgtgtccggttaagtttcattagagatgcattttaaaaggagcataagtgttggacattaagccttttgaattaattggggtatgcctttcaggttgcatctaacagctgtgcgctccccaataacgcatttgagctttgtccagggagactaagagcaaatagagatgttagaagactgagtcatgctttgcctcccggaaagtctctgggggaaaggagtggcctttctgaagggagtgacaaagtgcactaagaagggaggctgatcctcttctgtcatctgccaggctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctctt

SEQ ID NO: 432804 - DNA, 5791 bp, Homo sapiens
  misc_feature (3594)..(3594): n is a, c, g, or t
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggatttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaatgcc

SEQ ID NO: 432805 - DNA, 708 bp, Homo sapiens
agcgccagcgcctccccctcccccggcgcgcacggctcgtccccgtccctggaggcggcccgagccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgatcgctcgacagcgacagcccgcgcagcctgctactgctactgctgctgccgctgctgctgcctctggcgcccggggcctggggctagggcgcggggagccccaccagggccgaacgcccagacagaccgcacggtcatccatcatgggcctcatgccgatcaccaacgagagtggccaaagggcagcatacgaggcagcggagtgactcccccgccgttggaactggccatcgagcagatccgcaagagagtcactcctgcgacccctacttccatcgacctgctggctctatgacacggagttgcgacaacgcaaaagggttgaaagccttctacgatgcaataaaatacgggccgaaccact

SEQ ID NO: 432806 - DNA, 5738 bp, Homo sapiens
  misc_feature (3594)..(3594): n is a, c, g, or t
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggatttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaatcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaatgcc

SEQ ID NO: 432807 - DNA, 4363 bp, Homo sapiens
  misc_feature (3594)..(3594): n is a, c, g, or t
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaacctctagaacacgagggagaagagaggccctctaaaaacccccgcgtgggaaagctccccgggaggggccccaagccacccctgggcgaaaagagaggccaggggagccttctcggaaagaaaagggccctccgtggcacaacaacaatcacgcgggcctgggtgacaccccttcagagggctaagccccctgttcctcgcaacctcgggggagaagagaagggtgggaagagggccacacagaaggccccccaactgtgccaaggcccaatgtgaaccccagagccatccgcgggaaaacaggggagagctccggcaggaaccgccaaacagggggacccagcccccgtgggacaccaggacagcggccgcggaggggcgcgaggcgcgcaactggtgccacgcaggccggaaactctaacactggcctcccaaaggggggcaacccggggtgttcaaccccaacggggaacagtgcttggacaacccctcgggggaaaacggccccaacagggttaacacgagaagagagacaccaccatttcccgggggaaccacgcggggagaaatacagagggggccagcgagccacctggcccgagaacacacgcctccgtgcggacaaaatcgacgagaagaagctgggtgacaatgacgacccccaaacaagggttggggacaccaggccgccaggatggttgcaccaaaaagcgagaagtgaccccccgaggtcaacccggggggggggacaaccagcc

SEQ ID NO: 432808 - DNA, 5711 bp, Homo sapiens
  misc_feature (3514)..(3514): n is a, c, g, or t
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggatttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaatgcc

SEQ ID NO: 432809 - DNA, 3442 bp, Homo sapiens
  misc_feature (1245)..(1245): n is a, c, g, or t
gcggcactagggcagggcacaagtggggacagatggtgacatccagaagacccggctgacagcaaggcccccgaccctccctccctgcagcccacctcctgagtaaccctccactccacagcttctcagagcagcctgtgtgtgccaccccttggtaacgatcatctctcccctttctgttcaccatttcagttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggatttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaatgcc

SEQ ID NO: 432810 - DNA, 764 bp, Homo sapiens
aatccaggcttcatctcttattaagtttattatattgagcaagttacttagcccttttaagcctcagtttgctcatccataaaataagaataataacaatatttgcttttatatgagacactgcctctgaaaccatcaacctagaggcaggcacagagtaagtgttcattaaatgttagctattcctctcattgttgttactactgtggttcctcctgataattaagtatgtggacaaagcgctatggagtaattagttgtgctgcaggagttagagaggacttcatggaggaggtgacaattgatcgagatgtttaaggattattagaagtttgccaaatagaaagaatagggtattccagacaaaagaactagcacctacagagacctggagggtgaaaatcacagctcggccagggactaggagtggccaaacttcaacaaaatgcacatatgtgtttggggagtgataaggtcaagcttgtgaaaggccttgaatgtcacacagaggagcttggctggatttatcctgtgggtgatggggaatcgcaggagactctccggctggggggttcatgatgcaggttccccctatgacctgggcccccagttgctgcgtgggaagctgtctctcacatcggctcccctctgctccttcccgctctgtagatcatcaaggaccagaaactgcttgtgatcgtggggggcatgctgctgatcgacctgtgtatcctgatctgctggcaggctgtggaccccctgcg

SEQ ID NO: 432811 - DNA, 5041 bp, Homo sapiens
  misc_feature (2844)..(2844): n is a, c, g, or t
agggaagaaacagtgctgggagaactgagggagagcagggaaggctccctggaggaggtgtctgtgagtaggcctggacaaatgagtaggaagtatgatcccagaagtaagaaatgctgcatcctctcccactcaaagactcgagctggggccccagcacccccgacccctgacagatgtgatttcaacttgtggactgatcagaggtgccatattgacatgaggagacatgatttctgcagtgagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaanaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggatttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaatgcc

SEQ ID NO: 432812 - DNA, 2510 bp, Homo sapiens
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggaggtaagccctccatgccggcaggagggaagcctgcagatgcagcccctggcacatgaggacagtgaggctgcacagctcccagactgcccagtaccccactgggaacacttcatcagttccatttccttccatttgagacatgtaattccagggaggccaa

SEQ ID NO: 432813 - DNA, 222 bp, Homo sapiens
taccggcgctgcagccacgctggctcttgttctcttcctcatgtcctattagctgacctgacactaaatctgtcacctgctttatgacatgcttaccttattattttataagctcctctacatccctgtaaggagagtggtattgccccatcacacagaaactgacagagacactgacatgggaaactgagtggggaagtgtggccagcgtctcagcttggg

SEQ ID NO: 432814 - DNA, 2913 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgta

SEQ ID NO: 432815 - DNA, 4482 bp, Homo sapiens
gggggggtgaagggtcactgctgaccggaggcagctctgccaggcagtgtcatcagtgggcttcacgtttgactgacagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtatggtgagcctgacctggcctgtctcttcatctcttatccctgtactggtgcttcctcaaatgctttctggaagtagctaggagtagaatgcaaaggatagatcatcaaaggtctctctctcccacctccctccctctttccccaccacccccttccctcccccctcctctctctctcccccctcccttctctcctctctttctctctctctctcccccctccccctctcctttctctctctctcccccctcccactctcctctctctctttctgtctctctccctgctaagaaagtgggaacaatggagagtgttaggacagcgtggcatcccagtggggtccatctgagctcagggactgaagcctcagatgggaacttctccccagcccggcggctatgccccacactgcaggggggccactcactcttaactggctcagctagaactcactgccttgcaagcagcccctctgctcacccagcactcagcagacgggagtttgcaaagaattcaagagacaggtatctgaagaggaggaggtgggctgagggtgacaccgtgctgcctgcagtcagaggcctgtccttcaggatgtgtggataggccctgtgttgctgcatccccccacttgccacctcccccagcacacacacagcagcccacgccaggatctagccaagccttcacagcaggtgcccatgtccaagtccagaccaaggatgtcagacagtctactccttaagcgcctactccctaagagctctttcctcagcagaagtccaaactgcacccagaggccaggaccactccacctcacaagcacacaactccaaagactctttgccatcttgctccactgatgaacaactccgatggttggaagttcttcctcatacccagctcataacagcttatatccagctgccatttactaagtgctccaccaagggttttatgtcattcaggccagtgaaggggtaggtccgatcgttatctcaattttccagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 432816 - DNA, 3549 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtatggtgagcctgacctggcctgtctcttcatctcttatccctgtactggtgcttcctcaaatgctttctggaagtagctaggagtagaatgcaaaggatagatcatcaaaggtctctctctcccacctccctccctctttccccactcactcgatcgggcgccccagaaccaggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggacatgtacgtggccatccaggccgttgctagtccctactacgcctctgtgtgcgcaccactggcatttgtcatggactctggagacggggtcacccacacggtgcccatctacgagggctacgccctcccccacgccatcactgcgtctggaccctggctggccgggacctggaccgaatacctcatgaagatcctc

SEQ ID NO: 432817 - DNA, 2856 bp, Homo sapiens
  misc_feature (2848)..(2848): n is a, c, g, or t
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcgagtgagaactaaatctgactgtaatctgccttgctctacctgctccaggtttgattagtgtgctttttgcccatttccggttggccccatccatgatctttggccggttttcggccctactacctaaggtatcaaaaggggggaaaaaaaatcgaaaaaaaaaaggcgcccgggggggccaggccgtcgcgctcntattaagc

SEQ ID NO: 432818 - DNA, 2881 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccagggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgta

SEQ ID NO: 432819 - DNA, 3480 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacactccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtatggtgagcctgacctggcctgtctcttcatctcttatccctgtactggtgcttcctcaaatgctttctggaagtagctaggagtagaatgcaaaggatagatcatcaaaggtctctctctcccacctccctccctctttccccaccacccccttccctcccccctcctctctctctcccccctcccttctctcctctctttctctctctctctcccccctccccctctcctttctctctctctcccccctcccactctcctctctctctttctgtctctctccctgctaagaaagtgggaacaatggagagtgttaggacagcgtggcatcccagtggggtccatctgagctcagggactgaagcctcagatgggaacttctccccagcccggcggctatgccccacactgcaggggggccactcactcttaactggctcagctagaactcactgccttgcaagcagcccctctgctcacccagcactcagcagacgggagtttgcaaagaattcaagagacaggtatctgaagaggaggaggtgggctgagggtgacaccgtgctgcctgcagtcagaggcctgtccttcaggatgtgtggataggccctgtgttgctgcatccccccacttgccacctcccccagcacacacacagcagcccacgccaggatctagccaagccttcacagcaggtgcccatgtccaagtccagaccaaggatgtcagacagtctactccttaagcgcctactccctaagagctctttcctcagcagaagtccaaactgcacccagaggccaggaccactccacctcacaagcacacaactccaaagactctttgccatcttgctccactgatgaacaactccgatggttggaagttcttcctcatacccagctcataacagcttatatccagctgccatttactaagtgctccaccaagggttttatgtcattcaggccagtgaaggggtaggtccgatcgttatctcaattttccagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 432820 - DNA, 1785 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 432821 - DNA, 1397 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtggagcgttaggactctttgctgaggacccctggacggcttggcccaggggagcaggtcgtgccgaggcgggcgacgcgtgcagagcgagcacgatgggcgacaatgggccggaaagaggcagggacctactcggagcgtcggcagctgagcccccgtgggcatcgaggagggaaggcaccgcgaattgaccctgatccacacgggggaagaccgcagtcacccaatacggacataagggggcaccccagactgaggcggtacggacgggcggaatcggggaccaagacggagaccgagcacgcgggaggacccaggagacgaaacttggagacaaagggtccaaacaaaaggaagcgcaggcagggcacgggcggaagggccgggcacgggaagcgcaccgagagagtatcgccacgttgccttgcgaaccccgacagaaggatccgcaccagaagcccgagggtggcctccaagtcggtctatcacggaacactgagcccagccttgtagtggcccacagtgaccccaggtagcaggcgatcaccagccacgacggacaccggacacaaaggcaaagcgcccggcgacggtcagaggccgggacccacaagtgaaacaggcccatatccagtgcggtggtggaggcgtacagcgggcggagcagcgctgcaaggcacaggcctcggaagggaacacaagataaccccggaacacgctggagccagacgcgggcacgatggactccaggcaagagggagcagagtagggggcgacagagctacctgggaacgggccacgggcagcagggcacagcggctgagcagaaagccggccgacagatatcagaatgcaaggggaagggaattgacaacaggcggacaacgagatgaatagcaggccgagcagaggacaacaggagacaagccgcagaggagcgattgcaggaggagtacacccaggccacgacaagggcagaggacgtagacaggacaccggggtgaacaaggcccgaccccga

SEQ ID NO: 432822 - DNA, 333 bp, Homo sapiens
aaccccgagcacccctcaggtgagtgctgatgacagagctgagggtggggcaaggccagtcagtggagacaggagatggctggatggcaatgagaccctggactctagggagagcgtgccaggctgtgcagttgccccagcagagctgcaggggcccagagggagctccatgggggttccggtgccaggggaagtggctgggtgagatggctctggccagggctgatcctactgggcaaagagggccagttaaagactgtggaggccgccgggtgtggtggctcacacctgtaatcccagcactttgggaggccgaggagggcagatcacgag

SEQ ID NO: 432823 - DNA, 4536 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtatggtgagcctgacctggcctgtctcttcatctcttatccctgtactggtgcttcctcaaatgctttctggaagtagctaggagtagaatgcaaaggatagatcatcaaaggtctctctctcccacctccctccctctttccccaccacccccttccctcccccctcctctctctctcccccctcccttctctcctctctttctctctctctctcccccctccccctctcctttctctctctctcccccctcccactctcctctctctctttctgtctctctccctgctaagaaagtgggaacaatggagagtgttaggacagcgtggcatcccagtggggtccatctgagctcagggactgaagcctcagatgggaacttctccccagcccggcggctatgccccacactgcaggggggccactcactcttaactggctcagctagaactcactgccttgcaagcagcccctctgctcacccagcactcagcagacgggagtttgcaaagaattcaagagacaggtatctgaagaggaggaggtgggctgagggtgacaccgtgctgcctgcagtcagaggcctgtccttcaggatgtgtggataggccctgtgttgctgcatccccccacttgccacctcccccagcacacacacagcagcccacgccaggatctagccaagccttcacagcaggtgcccatgtccaagtccagaccaaggatgtcagacagtctactccttaagcgcctactccctaagagctctttcctcagcagaagtccaaactgcacccagaggccaggaccactccacctcacaagcacacaactccaaagactctttgccatcttgctccactgatgaacaactccgatggttggaagttcttcctcatacccagctcataacagcttatatccagctgccatttactaagtgctccaccaagggttttatgtcattcaggccagtgaaggggtaggtccgatcgttatctcaattttccagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 432824 - DNA, 3332 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtaaaaaaaaaaaaaaaaaaaaacagaaaaaaaaaaaaaaaaaaaaaaaaaaaaacaacaaaaaacaaaaacaaaaaaaaaaaaaaaaataaaaaaaaaaaaaacacacgaggagggagacgcggcacaggataccgcgcaccggcagccagaacacccacacccgctctttgacaaccacaagcgaaggccgacccgcgacgcgcgggccggcgctttctttcacaaccacagcccgcggccgcggcgggcgcacacaccaccccaccgcccgccgcggcgacgacaccaaaccaacccccgcgacgaccctccctgagcagacaaccaccacaccccccagcacgcccggcgatacaccacacacgcgaccaaaacaccccaccaacgaatcacgcacgcacccccccgacacacacaac

SEQ ID NO: 432825 - DNA, 3564 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgtatggtgagcctgacctggcctgtctcttcatctcttatccctgtactggtgcttcctcaaatgctttctggaagtagctaggagtagaatgcaaaggatagatcatcaaaggtctctctctcccacctccctccctctttccccaccacccccttccctcccccctcctctctctctcccccctcccttctctcctctctttctctctctctctcccccctccccctctcctttctctctctctcccccctcccactctcctctctctctttctgtctctctccctgctaagaaagtgggaacaatggagagtgttaggacagcgtggcatcccagtggggtccatctgagctcagggactgaagcctcagatgggaacttctccccagcccggcggctatgccccacactgcaggggggccactcactcttaactggctcagctagaactcactgccttgcaagcagcccctctgctcacccagcactcagcagacgggagtttgcaaagaattcaagagacaggtatctgaagaggaggaggtgggctgagggtgacaccgtgctgcctgcagtcagaggcctgtccttcaggatgtgtggataggccctgtgttgctgcatccccccacttgccacctcccccagcacacacacagcagcccacgccaggatctagccaagccttcacagcaggtgcccatgtccaagtccagaccaaggatgtcagacagtctactccttaagcgcctactccctaagagctctttcctcagcagaagtccaaactgcacccagaggccaggaccactccacctcacaagcacacaactccaaagactctttgccatcttgctccactgatgaacaactccgatggttggaagttcttcctcatacccagctcataacagcttatatccagctgccatttactaagtgctccaccaagggttttatgtcattcaggccagtgaaggggtaggtccgatcgttatctcaattttccagatggggaaactgaagtttgcgaggctgatgctaagaagtgctggtgccagaatctgaacccagctctgactccaaggcttgcatttttaaccatcatcccctccacctgcctgtggtttgcagcccctgcttctgctttgtatctggagcaatgcatcttccactgctccagactgggcatcctcagctcccttccttccatctgcggtctccagcccctagtcaggaccaggggagaggcagggcaccaagaagtagcccagtccccagggtggccaaaatccctccatctaggacctgcatcatggaagctcttcaagcaacctccccaaaactgctggttcccgtgaagctggatggtaaccgaaaccccgatcttttagacaatatccattgcaaagtcatatccaaattgtatgtatgctgtttttgttttgttttagataaaagcaggactttacactgatctttaacagatctcaccttgttgggtttgacccatttccccacctgtattaaactttttagaacttagctctcctttagagctttatgtatctgcaaacttgaatagcctcattcaagtcactaataaaggtcgaaatgaagaggg

SEQ ID NO: 432826 - DNA, 1857 bp, Homo sapiens
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacactccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgctgta

SEQ ID NO: 432827 - DNA, 1006 bp, Homo sapiens
  misc_feature (963)..(963): n is a, c, g, or t
  misc_feature (966)..(966): n is a, c, g, or t
  misc_feature (970)..(970): n is a, c, g, or t
tccgcagcggctcaggctcagtcgctcagtcagtctcgggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggacccgnccngagngtccctttattgacccgacccacaaggggcctaagg

SEQ ID NO: 432828 - DNA, 1295 bp, Homo sapiens
tccagctttttcatctcttgacttttagatggcattttcaacatgatgtcatgattaaatgatgacaacttgatgatatgatggtttaaggaaattttgttggtagtaggtaagtcccagcatttctgactgttggttttcttttccttgtggtagaaaagacaaatgccaattttgaaatcttgaatgcagtaggcagttgtgttgaaatagtatgtgagaattacttgcaagctgaacatccaggtctggggcatgaacctggcatacaatgtagatttctgtgttcgttaggcaacagctacattgtctgctgggtttcaggctacctggaaacatgttctccattggctgtctcaccaatgctacccctataatgtttctgaataactgttttccaggaggtataaaccagtggagtttatcattgaatagagtgcagagaaaggaccgcaagaaagctgatcacctcagcaatgaatgatttcaatacgatttcacccaaatggtctcacacaccagcctagtaaaccagagataaggtgtaatgtcatccttccttccttctccctgcctcaactgtcaaagattgacaacttacatgttgtttactttttggcttctatttctgttcataattattatcagaaggcatagcacccacaagcctaatcatactgccttacaaccttattcctcttcattttgtcttctcacttacctgcagaaacccagtttatttttgttctccctttaccacaccagccttgtaactgttatgaatgaccctcaatctcactggaatctgaatcactcaggaattcaagcaaactggatgttttaaccactgttcagctttcttatggaatgacagagaacttgtaaagataaaacaccagtttgcaggaagaaaggaagagaatggaaattgcttctggaaaatactagttttacaatatgttttgtttgtctgctctcttaaataaacttaatcctataaacattttttaagaactagccattaagactgttaagttctcaattataaaggaataaaatgttttaaggaggatttatttgcccttgcttatatgaactgcatatttttagtaggaaatcatgtaatttaaattagtattggttaacagatttaacgtagaaaatggacatataaagaatacaaggataaatgtctacatgtaataatggatggtagtgatataatgcatttttgtcatcccatgctgaattcagtaaaaataaagctaatgacttggagcttttaaaagattgta

SEQ ID NO: 432829 - DNA, 613 bp, Homo sapiens
taagagaagtgacaggagcggaccggttttatttcatcacggggccggggtttagttgaacgtcctgtcgttgtctctacaattattcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432830 - DNA, 2486 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432831 - DNA, 2348 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattatggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432832 - DNA, 2434 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432833 - DNA, 2546 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagtgatgacagcaactcgcctccagaagagaacccatttctctgatgctatcttccctgcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432834 - DNA, 1895 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggactt

SEQ ID NO: 432835 - DNA, 2743 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcaggtgtgaacttggccttaggtgggccaggcctggggatccggggctcatggggttttacgtctatgacagtgattgccttcaatggtggtgtttctccttgatgataatggtaatgactccccttctgatgctagctcctttcattgacaatgtcttcctttaatgaaaccattttattcactgaccacatttcccagtgatgacagcaactcgcctccagaagagaacccatttctctgatgctatcttccctgcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432836 - DNA, 2543 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcaggtgtgaacttggccttaggtgggccaggcctggggatccggggctcatggggttttacgtctatgacagtgattgccttcaatggtggtgtttctccttgatgataatgctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432837 - DNA, 2595 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcaggtgtgaacttggccttaggtgggccaggcctggggatccggggctcatggggttttacgtctatgacagtgattgccttcaatggtggtgtttctccttgatgataatgctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432838 - DNA, 2494 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcagtgatgacagcaactcgcctccagaagagaacccatttctctgatgctatcttccctgcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432839 - DNA, 1802 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctgggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432840 - DNA, 2101 bp, Homo sapiens
aaggctagtagaggcgggggtaatcggccgagggtcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432841 - DNA, 2213 bp, Homo sapiens
tcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagtgttggtctatactgactcttatttctcagggagatcacagcaacctaaataaaccagatacctttt

SEQ ID NO: 432842 - DNA, 236 bp, Homo sapiens
gaaacctggggcacggagtcagggggtgagtatggattttctttcctcctccctttcaggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcag

SEQ ID NO: 432843 - DNA, 604 bp, Homo sapiens
ttttggggggaaaaaccccttaaaaaaccccttttccgtggggggggcctcttttttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtgcggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaaga

SEQ ID NO: 432844 - DNA, 2013 bp, Homo sapiens
gaattcggctcgaggcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtgcggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttaggggctcacaaataaaatctgaatacctgtaaggaaagaggttttttatcacataccttaagtctttgtaatgttcatgcttaaattctaag

SEQ ID NO: 432845 - DNA, 495 bp, Homo sapiens
gaattcggctcgaggcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggtaaggatgagcaagacatactgtcaatctaattgcagcctgagctaaagtaggagcaaagggcaaaccttaataatttgggatcacttctgtgtgatccaaaggatccgctagactcttggcaccctggaataccaggttcataggctgggaggctcctcaacagcattgagtccgaaacgaccaggtcatagtcttcgttccagtatatctgcc

SEQ ID NO: 432846 - DNA, 1709 bp, Homo sapiens
gaattcggctcgaggcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtgcggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaaga

SEQ ID NO: 432847 - DNA, 1400 bp, Homo sapiens
ctccatagattgatgtttattcccaatcttgctgttatgtataatgtttaacaaactaatctgcataaaaacttgacttctttaagataaattgcctatttattgaccaataattctttccttagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtgcggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaaga

SEQ ID NO: 432848 - DNA, 5354 bp, Homo sapiens
tgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtagccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatatcgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagtgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttgataggatagatacccacatacagtataatatatcccattcaggtttcagagtttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatggg

SEQ ID NO: 432849 - DNA, 670 bp, Homo sapiens
gggctctgctctgagcttgtcttcataggtctgtgaagaagttgctcccaagaccctttgtgggaagaaagaagttaggatgaaaggcctattgaaaagccattgctgctctcacctccctgggagcacacattaggtcttgtcccaatagggaagctctaggacctctacaggctgacaaagccatatattcacaaacactgagtgatatggagaatatagaccgagaaactctttgccctaaaatatccaggaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggaggtagaagcagctattgttgtcctatttcctacaatgattgccttttttgatgtgttctgtaacagtgaccttgctaaaatgaccagccattcaaagataaattgtgatgttggggcatctctgggtatcccatcccagctataaaagaaacaaacaaaaacataattcagttcagtgttggtagaaaactctacctagattttttttaaaaacaaaaacttgttctcttgaat

SEQ ID NO: 432850 - DNA, 604 bp, Homo sapiens
gtggcccttgaggccaagaattgggcacaggaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatggg

SEQ ID NO: 432851 - DNA, 419 bp, Homo sapiens
cccatccaccgtgcccttctcaagaggaattcctcagtcctgtgaggcatcatgggtatggtatacaaactcccttattagagtttagtaacctagcattcatattttctttaaatgccgtagtcaaccttgcacatctaccaggggaggtcagagttcatccttgctcacttccagttggaggcgaggtcagccgccagccacccttggagctggtgtgcaggtttggggcctctgaagcccgggcttgatggagcacctcacctgctgactcacccaagggtggtgagcccgccctccacatcgctgtccctgacctgccattttgattggtgcattttttggtacaacaggaagtcatgttcatggcatactctacgcatgagaggggcggagggggatcctcgacagtcgtcctc

SEQ ID NO: 432852 - DNA, 2027 bp, Homo sapiens
acctctcacattacttaaagattcttcaacttcattggaaaacatgcagacctgtcttccatgcctttgaacccttattcaaagcaccccagttcttcagttcctttttcttctaatattgctgcctgtgtttcaggaggtaaaacaggagataaatcagaggctgacactgagtgacttcctcatcaagcccattcagagaataacaaaataccagttgctcctcaaggacttcctgagatacagtgagaaggctggtttggagtgttcagatatcgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagtaagtgcctcgttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatttttgattgacaccaaaaaattaccttggcacaaatgccagacctgtgaaggtcagaggcccgctgcttctcccaggagggagggaactttttggttgtctgtggcaattcctctgtacagattgtaactttttaaaaatttcccttcaccccgtcacttgaatatatgttcatagtaatttgtaagatacttcttttccttattttggttgcaagacccttccgaacacattcctgtataaagtattttgcactatttaaagaaacccatatggatgaagtcaggatgtgcaatatgatggcgtcacagtgctcatcgttgtacctgtaatgtaactaatcagtttaaatgtactattttaaatatgtaaaataaattttcaccatgagcatgttttaatgaagttaaaga

SEQ ID NO: 432853 - DNA, 1540 bp, Homo sapiens
gccttctctctctttgcacaaccctggcacctcacatatggcaccgttttgttttttgtattttcattatttaggtagatgtcttagttctcccattgccttaaaaacaagggtagtgtttttctcacttatccacacgatgcctaacacaaagccttggacctaagaggcctccaaatccttgtgggattcccaaagcttagagtaaccacctgctcttatcccacagcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagtaagtgcctcgttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatttttgattgacaccaaaaaattaccttggcacaaatgccagacctgtgaaggtcagaggcccgctgcttctcccaggagggagggaactttttggttgtctgtggcaattcctctgtacagattgtaactttttaaaaatttcccttcaccccgtcacttgaatatatgttcatagtaatttgtaagatacttcttttccttattttggttgcaagacccttccgaacacattcctgtataaagtattttgcactatttaaagaaacccatatggatgaagtcaggatgtgcaatatgatggcgtcacagtgctcatcgttgtacctgtaatgtaactaatcagtttaaatgtactattttaaatatgtaaaataaattttcaccatgagcatgttttaatgaagttaaaga

SEQ ID NO: 432854 - DNA, 1676 bp, Homo sapiens
tgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtagccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatatcgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatctctccgtagatacactgctgctacgttataactgtgtccctgtatagctgttcct

SEQ ID NO: 432855 - DNA, 443 bp, Homo sapiens
gaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgaggtacttacagggggccctggagttgtccatcaggagggccttctgacatgtctccttcctcaggttttgtcaactaggccatctcaaatctccattagtgtgttaccttgagcctaagtgatttggattctttttattcttaagacattggccagtttgatttgtggctgattcagaagctgactagcccctaagacttccagcagacagaaaccatttgccagatttggagataggacctgggcctgaggggagtcatttggtcattagttccctacctctacta

SEQ ID NO: 432856 - DNA, 2965 bp, Homo sapiens
tgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtagccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatatcgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagtaagtgcctcgttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatttttgattgacaccaaaaaattaccttggcacaaatgccagacctgtgaaggtcagaggcccgctgcttctcccaggagggagggaactttttggttgtctgtggcaattcctctgtacagattgtaactttttaaaaatttcccttcaccccgtcacttgaatatatgttcatagtaatttgtaagatacttcttttccttattttggttgcaagacccttccgaacacattcctgtataaagtattttgcactatttaaagaaacccatatggatgaagtcaggatgtgcaatatgatggcgtcacagtgctcatcgttgtacctgtaatgtaactaatcagtttaaatgtactattttaaatatgtaaaataaattttcaccatgagcatgttttaatgaagttaaaga

SEQ ID NO: 432857 - DNA, 5641 bp, Homo sapiens
tgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtagccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatatcgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagtgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttgataggatagatacccacatacagtataatatatcccattcaggtttcagagtttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatcccacccttagttttcctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcaaaaaaaat

SEQ ID NO: 432858 - DNA, 3750 bp, Homo sapiens
gggctctgctctgagcttgtcttcataggtctgtgaagaagttgctcccaagaccctttgtgggaagaaagaagttaggatgaaaggcctattgaaaagccattgctgctctcacctccctgggagcacacattaggtcttgtcccaatagggaagctctaggacctctacaggctgacaaagccatatattcacaaacactgagtgatatggagaatatagaccgagaaactctttgccctaaaatatccaggaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagtgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttgataggatagatacccacatacagtataatatatcccattcaggtttcagagtttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatcccacccttagttttcctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcaaaaaaaat

SEQ ID NO: 432859 - DNA, 314 bp, Homo sapiens
atatgctttcagagcatgtttattaatatcatgtcattgctcaagagagaatgctgcctgctgcctaccctgctagtgggagatttggccttgaaccactgggtagggtgcagagcaagcccatgtgaactagcgtccttgtgtttgtgcccctctcacccttatctcccagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctgg

SEQ ID NO: 432860 - DNA, 3626 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432861 - DNA, 3724 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432862 - DNA, 3373 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432863 - DNA, 3252 bp, Homo sapiens
aaccgccccgtctgagaagtgaggagcctctccgcccggcagccaccccgtctgggaagccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432864 - DNA, 3313 bp, Homo sapiens
aagtgtattaaaaagaagaaatagtcgtaagatggcagtataaattcatctctgcatgtagaaaccggaaaaaaagcaagttcagtacttcaccaaaaaatttcaacattgcaaacacaggaaattgagaactgacaaacagaaatactaggaaatgcaaagtcttgaagctccaaaacaaaaacagcaatcttggaaaggcccctaatctacctcctcaatggtggggcctgacccagaccctcccttgggaccctgagccccgaagcccccaggcccgggaccaccggcaccctggtacagtccgctgatgcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432865 - DNA, 2200 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtggcaaattttaaattaattcattaagggcgatttaaattttttttttggggcggggatagccttataaaaattaccccccagttctttatttaaaaaggg

SEQ ID NO: 432866 - DNA, 3868 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtgtaccagaggaagaagaaaggcgtgtcccccaaaggctgtccttgcagtagctggaagccaggtgagggcggcttcaaccacttctcagtctcttctggtgcgagcgcctgcctgggcatctgccctttgcttggcatatgccaaacgtttaccagctttaattcactggatccttacagtaaccgctcgagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432867 - DNA, 3000 bp, Homo sapiens
tttggtcatgtttcgatttcctttgttgttagtaggtcctgagcagtgatagtctcataaccctggggctccggagcgccgcgcctcctgcgtgggcgaattcctcgtgtcgtggccgcgcgggcgctcaggttatatggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432868 - DNA, 3238 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432869 - DNA, 1444 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaaggg

SEQ ID NO: 432870 - DNA, 1196 bp, Homo sapiens
tgagacggagtcttgctctgttgcccatgctggagtgcagtggtgcgatctcagctcactgcaagctccgcctcccaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432871 - DNA, 1248 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtgtaccagaggaagaagaaaggcgtgtcccccaaaggctgtccttgcagtagctggaagccagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgcccgcctcagtctcccaaagtgctggggttacaagcatgagccaccatgcccagccacagtgtaaattttatttgtaattattggatttctggttcaagttgatgtttgaaaaataaaaaaagaaaaatattttaaaaatataatta

SEQ ID NO: 432872 - DNA, 1723 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtgtaccagaggaagaagaaaggcgtgtcccccaaaggctgtccttgcagtagctggaagccaggtgagggcggcttcaaccacttctcagtctcttctggtgcgagcgcctgcctgggcatctgccctttgcttggcatatgccaaacgtttaccagctttaattcactggatccttacagtaaccgctcgaggtgggtgttagccccatttcaccgccgaggcaactaaggctccgagctgcgctgtccaacataaatagaatgcaagctgcattgaaaattgtaatttaaaattttccagtaggcacgttttaaaaaagtgaaaccgatattaattttaatagcatatcttatttaactaatttttgtttttttagtggagacagggtttcaccatgttggccgggctggtctccaactcctgacatcaggttatcttgccttggccccccaaattgctgccattataggcctgagccacagcacccagccttatttttatttttttgagacagtctggctctgttgcccaggcttgagtgcagtggtgcgatctcggctcactgcaacatccacctcctgggttcaagtgattctcatgcctcagcctcccgagtagttgggactacaggcacccgctgctgcgcccagctaattttttatatttttagtagagacagggtttcaccgtggtctcgatctcctgaccttgtgatccgcctgcctcggcctcccaaaatgctgggattacaggtatgagcccgcgcctggcccaacttcaggcagttttattaggagtttaaacttgaggcaagaggacaatgaaaagaagctcttcaccatctcccactatatatatagatatatatagtgtaaatatataggagtaaaatttgtattagaa

SEQ ID NO: 432873 - DNA, 1234 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgcccgcctcagtctcccaaagtgctggggttacaagcatgagccaccatgcccagccacagtgtaaattttatttgtaattattggatttctggttcaagttgatgtttgaaaaataaaaaaagaaaaatattttaaaaatataatta

SEQ ID NO: 432874 - DNA, 873 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgcctcaggccggcgagtccccttctcagagacttggctaggcgcggcgcgaggcgggcgctgcggcgccagcagccctgtggtggcgacgacgatggaccaggagccagtgggcggtgtggaacgaggagaagc

SEQ ID NO: 432875 - DNA, 418 bp, Homo sapiens
cttaagtttatactttgtttatgcaaactataaaatttcccataaatgtattcaatggtttgtcttactttaagcctctttcactcactttttcctatctccttttcagtccttttaagaattccagttccagctgggcacggtggcccacgcctgtagtcccagcactttgggaggccaaggtgggcggatcactaggtcaggagtccgagaccaacctggccaacatggtgaattagtagagatggatttctactaaaaatacaaaaattagccgggcatggtagcaggtgcttgtaatcctagctgctcgggaggctgaggcaggagagtcacttgagcctgggaggcggaggttgcagtgaatggagtttgcaccattgtactccagcctgggcgacacagcaagactcgtctc

SEQ ID NO: 432876 - DNA, 470 bp, Homo sapiens
tgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcaggtactaacttgtttacttcagcagcaacctaacttgattttattaccaggatagagagcaatatggatttccaactagtttttaaggcgtagatggttttcaaatgattatttgttttttaaagtttttggttttgtttttaggttccagttatacatagaataggaagtgtacaataacattaggcaga

SEQ ID NO: 432877 - DNA, 3466 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgta

SEQ ID NO: 432878 - DNA, 3412 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432879 - DNA, 3477 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatgggaaattttatagtttgcataaacaaagtataaacttaaggcacagtgaataactatattgataaacataaacgtcgacgc

SEQ ID NO: 432880 - DNA, 2683 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaagtttttttttatttccctccccctgtcccccaccccccccccatttattttttaaaggtggtgatgaaccct

SEQ ID NO: 432881 - DNA, 3738 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtgtaccagaggaagaagaaaggcgtgtcccccaaaggctgtccttgcagtagctggaagccagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432882 - DNA, 3952 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcaggtaggtggggccgccgaggctgacgtccggggagccgagccgcctccttgccttctccgcgggccgctcttttagcctgcgcggccgtcctccgagcaggccgccccagctttggagttcctcctcactgcacccctgtttctgctcactgagaccagcttgtgggaaggagcgccccccgcctcactcaccaaccccttggctggcagcacagcagactctggggcggcctcgggttcctggggtgatagtccagcttctggtgtaccagaggaagaagaaaggcgtgtcccccaaaggctgtccttgcagtagctggaagccagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432883 - DNA, 2954 bp, Homo sapiens
  misc_feature (73)..(73): n is a, c, g, or t
cttctcctcgttccacaccgcccactggctcctggtccatcgtcgtcgccaccacagggctgctggcgccgcngcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtaaacaacatcacacaacaacacaacgacactgtcggaacacaaaaaaatttcgccccgcgcccaagattaacacgtgggcgcgcagaaaaaaagccaagcccgaacacgaaaacggcgtccaaaaacaccgcagggggacacggtcgggccggaaatcacc

SEQ ID NO: 432884 - DNA, 1368 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagtgtttttttttttaatacaaaaactttcacattctttattcagtgggacttaatacaattatttatattttaaattattaaagtatctggaaaggg

SEQ ID NO: 432885 - DNA, 1136 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagtgcaaaaaccgaggtcctgcggggtgactgccccagacgccgctggtgacgggctgcgccgaggtcgagacgccaggcttcaggtacacgtaccagaaatgacgtcacaggcggtgccaggcggggatccacgagctctggatgcttgcttggccggaagcgacgccccgcaaggacccgccccgccccgccccgccccgcgcgagccggtagttgcgcctcccagactgcagttggccagctctcggggtgcggagcccggcgggctaggcgaggcgcgggctggccccgcccctcaggccggcgagtccccttctcagagacttggctaggcgcggcgcgaggcgggcgctgcggcgccagcagccctgtggtggcgacgacgatggaccaggagccagtgggcggtgtggaacgaggagaagccgtcgcagcctcgggagctgcggccgccgcggcattcggggaatctgcagggcagaatctcactctgttgcccaggctgaagttcatggcgcgatctcggctcgctgcaacctccacctcccgggttcaagcaattctcctgcctcagcctcctgtgtagctgggattataggcacgctccaccgcgcctggctaatttttgtatttttttagtagaggtgggatttcaccatgttagccagggtggtctcacacccttgacctcaagttgtctgcccgcctcagtctcccaaagtgctggggttacaagcatgagccaccatgcccagccacagtgtaaattttatttgtaattattggatttctggttcaagttgatgtttgaaaaataaaaaaagaaaaatattttaaaaatataatta

SEQ ID NO: 432886 - DNA, 2988 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432887 - DNA, 2737 bp, Homo sapiens
cagcaggctgagtgttcatgtcaccagaagtctgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctgaggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432888 - DNA, 2950 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttccatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432889 - DNA, 3542 bp, Homo sapiens
  misc_feature (258)..(258): n is a, c, g, or t
  misc_feature (574)..(574): n is a, c, g, or t
  misc_feature (1384)..(1384): n is a, c, g, or t
  misc_feature (1396)..(1396): n is a, c, g, or t
ttgtaagttgcagattaccaactaaggtttctagctcaaaacatgatggagcatgaaggaaatgttgagatctgagagcacctcaggaggagccaagaaagagaatcatctggattcaccatgtagaccgtagagcagaacaggaaaggcctgaagtgggtcatccaggcttaggtgctcttggaatatggttcctaatggggtgtgtgcagcctcaatgtagacacatccccttggcactgtggatgctcatatcanggagcagtgtgcccagaagagagtcctctagttggggacctctagtgcacccagaggagggtcctctggttgggggtcttaggcaggagcccttctgctctgggtccaagagtggggttggggttgacattggggaagtgtgtatcctcaacactagtattgtaagtgctcaatacatgtccacttaataaattaatgtatctgataagtgatccctgtctaacagtgtggcagaaaatgccctgctttgcaatatgaagataacctttgtcccgttctttgctttcttctctaagtctatattcattgcctcccngagtgtgtaaccacatgagaaatagagggaaggttctgtccttaagaagttaaaagtgtgactgggaaggtaaaacatacttattaagggttaactagcatcatgccattctgtgtgatggtgagtttgtgtgtgtgtgcacatgtgcgtgagtacacacatatacatttaaaaaggtcttgaatataccaaaatattatgtctaggtgatgggtagcttgtatattttttctgtatccttgtctgtgtttgtcaaattttatagaaacaataacagtaacagctctctgaccttctaccctgtatgttctgcgtcctgtctaattcctcaagttccttcactgcctgtcactctgatgcttgctatatatcagtccatcctgctttttgtttcttagacccaaagtgtcaagtgcacacctgccctgggtctttgtgtttgctgtttccatttcctggagtgcagctggccctgatttgcatgtgaccagcaacttttcatctatgtctcaactcaaatgtcacctcttcactgaccatcctgtctaatgattccctccatctcatcccactcaccccagccactctctgttccattgccctgttttattttcttcacggtgcatcattctttgcaatgactttatttacttgttcattatttgcttctctcactagaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432890 - DNA, 3684 bp, Homo sapiens
  misc_feature (1526)..(1526): n is a, c, g, or t
  misc_feature (1538)..(1538): n is a, c, g, or t
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432891 - DNA, 3940 bp, Homo sapiens
  misc_feature (1526)..(1526): n is a, c, g, or t
  misc_feature (1538)..(1538): n is a, c, g, or t
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctatatagatctagattttcacatataaggattccttaaagcaaggaacatcatagtacaataaaaataagacaaaatctcgttcaaggagctgtctgtattcaacaccctgaaagttctgagctacatcaacagctggaacagtacagaaacactatctctcagggaggacagagtaccaggtaccaaatagatcctggcaaaggaacaggcatggaagtttccagagcacattcccatgctttatctctcttacaggttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432892 - DNA, 3747 bp, Homo sapiens
  misc_feature (1526)..(1526): n is a, c, g, or t
  misc_feature (1538)..(1538): n is a, c, g, or t
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatccatagccgggtggatgtcatcagacacgtggtgaagaatggtctactctgggatgagttgtatataggattccaaacacggctccagcgggatcctgacatataccatcacctatatagatctagattttcacatataaggattccttaaagcaaggaacatcatagtacaataaaaataagacaaaatctcgttcaaggagctgtctgtattcaacaccctgaaagttctgagctacatcaacagctggaacagtacagaaacactatctctcagggaggacagagtaccaggttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432893 - DNA, 3536 bp, Homo sapiens
  misc_feature (1378)..(1378): n is a, c, g, or t
  misc_feature (1390)..(1390): n is a, c, g, or t
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432894 - DNA, 2929 bp, Homo sapiens
  misc_feature (258)..(258): n is a, c, g, or t
  misc_feature (574)..(574): n is a, c, g, or t
ttgtaagttgcagattaccaactaaggtttctagctcaaaacatgatggagcatgaaggaaatgttgagatctgagagcacctcaggaggagccaagaaagagaatcatctggattcaccatgtagaccgtagagcagaacaggaaaggcctgaagtgggtcatccaggcttaggtgctcttggaatatggttcctaatggggtgtgtgcagcctcaatgtagacacatccccttggcactgtggatgctcatatcanggagcagtgtgcccagaagagagtcctctagttggggacctctagtgcacccagaggagggtcctctggttgggggtcttaggcaggagcccttctgctctgggtccaagagtggggttggggttgacattggggaagtgtgtatcctcaacactagtattgtaagtgctcaatacatgtccacttaataaattaatgtatctgataagtgatccctgtctaacagtgtggcagaaaatgccctgctttgcaatatgaagataacctttgtcccgttctttgctttcttctctaagtctatattcattgcctcccngagtgtgtaaccacatgagaaatagagggaaggttctgtccttaagaagttaaaagtgtgactgggaaggtaaaacatacttattaagggttaactagcatcatgccattctgtgtgatggtgagtttgtgtgtgtgtgcacatgtgcgtgagtacacacatatacatttaaaaaggtcttgaatataccaaaatattatgtctaggtgatgggtagcttgtatattttttctgtatccttgtctgtgtttgtcaaattttatagaaacaataacagtaacagctctctgaccttctaccctgtatgttctgcgtcctgtctaattcctcaagttccttcactgcctgtcactctgatgcttgctatatatcagtccatcctgctttttgtttcttagacccaaagtgtcaagtgcacacctgccctgggtctttgtgtttgctgtttccatttcctggagtgcagctggccctgatttgcatgtgaccagcaacttttcatctatgtctcaactcaaatgtcacctcttcactgaccatcctgtctaatgattccctccatctcatcccactcaccccagccactctctgttccattgccctgttttattttcttcacggtgcatcattctttgcaatgactttatttacttgttcattatttgcttctctcactagaatgaacactccatgagagcagggacctgctttgccttgttcaccactttattcccagtggctagaaccacgtctgacacagaaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432895 - DNA, 3171 bp, Homo sapiens
  misc_feature (1526)..(1526): n is a, c, g, or t
  misc_feature (1538)..(1538): n is a, c, g, or t
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaattctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432896 - DNA, 1345 bp, Homo sapiens
tgtaagttaaattcctaggagcggggctgctggattctatgaatacagcgtctaggcttttagtgccctctgccaaatcgttcttcgggaagccagttcacctttccaaaaataatgtatgagagaatacatttacctgtaccttcactaatactagattctgttgcttttgtgtacaagatatagatctagattttcacatataaggattccttaaagcaaggaacatcatagtacaataaaaataagacaaaatctcgttcaaggagctgtctgtattcaacaccctgaaagttctgagctacatcaacagctggaacagtacagaaacactatctctcagggaggacagagtaccaggtaccaaatagatcctggcaaaggaacaggcatggaagtttccagagcacattcccatgctttatctctcttacaggttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432897 - DNA, 2187 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtatggctagacactttgtacatttttacatacaacttaacgtatggtggaatgagcgactttgctgtgaaagcagtgtgacatgagaaggaaagtgattagtaggtgtctggaactttttaacaagctgctggagaacccagagcatgaataaaagttacacttggcagccaggaactctttcagaagataaaataacagatagatattctccgaaaggatcccaggaaagaggatggcaactgccatttattatgtgaagtgaactggggacttttaactaagccatctaagttaatctcccaatagcactatgcgtaggaagggggtattgttccttttttgcagataaggaatctgaaactcagaaaggtcaagggacgtgcccaaagtcaccctgttggaaacatgagttgagaatggaaccctggtatgcttagttctaaagctcttttctctataccatactgcattccagaatagaattatgtctttcttctcatgttttaggtatctaatgtgatttttcttgcagcaatataacttctgcaaatactatgaatcatcaccaatgtatgaaattgttgaaagaaataaaagaccatgaatttgaaacaaaaaa

SEQ ID NO: 432898 - DNA, 953 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagtttctaggttccagccaagaacagagacctacctgttctacccaccattattcagccatttttcttctcaacacaaccaagatcaacaaatcctataagccatgattctcatctttaaagcctatcaatttttcacaacctcctctaactggaaaactgttgtctccctgtcatctatgaccgcatggttctgccaattttccctttcatggcctggcatgccaaata

SEQ ID NO: 432899 - DNA, 723 bp, Homo sapiens
agtataaggcatgtctagaaaagtgacatgccatggtaagtgaacaatagatgttgaccatatcagccccatgaaataaacaggaataccatgtggcccacagtcagttggtaaatccttaagacttgggaggagggtcatattccagttcacattccagttttagattctcgcttatcttaaagcattatagaccttgaactaaataagaataaaaatttgccccagtgcagtaagaaaatgaaaaggcattgaaatgagattcatactgttgttcattaataatatcttcatttcacaggaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattg

SEQ ID NO: 432900 - DNA, 236 bp, Homo sapiens
gactctggtgagagtccagtttttcaattcctcacttctctgtcaatatgttggtataaggaacaaactgtctgtcatactagatgacactatttttttctcttttcaacctttccatctgtcttatcctagttaccccacactgaaaaagcttgctgggagaagaccagatattcccatttatgttggaaacacagaaaggcctgtattttggaatctgaatcagagcggtgtcc

SEQ ID NO: 432901 - DNA, 2647 bp, Homo sapiens
gtctacaccagcggtgtcgctgcccgaaagtgagagaaggctgatattgctagctggaatccaggcctgggtgctgcatggtggcgcccctccccgtgaccaccgctgcgttttctcgggctttctctgaggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432902 - DNA, 2536 bp, Homo sapiens
tgtgaaaggcagtgggctaagtggtagggggagaaggaagatacagagtgctttcaaaagtgcctaaatcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432903 - DNA, 2767 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaattctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432904 - DNA, 3134 bp, Homo sapiens
  misc_feature (976)..(976): n is a, c, g, or t
  misc_feature (988)..(988): n is a, c, g, or t
tgactctacaggatccccaggacagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttacgtgaatgaataagcaaatgaacngcactgtgagangggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaacatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432905 - DNA, 2852 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacgggtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatga

SEQ ID NO: 432906 - DNA, 2270 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagacagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtatggctagacactttgtacatttttacatacaacttaacgtatggtggaatgagcgactttgctgtgaaagcagtgtgacatgagaaggaaagtgattagtaggtgtctggaactttttaacaagctgctggagaacccagagcatgaataaaagttacacttggcagccaggaactctttcagaagataaaataacagatagatattctccgaaaggatcccaggaaagaggatggcaactgccatttattatgtgaagtgaactggggacttttaactaagccatctaagttaatctcccaatagcactatgcgtaggaagggggtattgttccttttttgcagataaggaatctgaaactcagaaaggtcaagggacgtgcccaaagtcaccctgttggaaacatgagttgagaatggaaccctggtatgcttagttctaaagctcttttctctataccatactgcattccagaatagaattatgtctttcttctcatgttttaggtatctaatgtgatttttcttgcagcaatataacttctgcaaatactatgaatcatcaccaatgtatgaaattgttgaaagaaataaaagaccatgaatttgaaacaaaaaa

SEQ ID NO: 432907 - DNA, 2277 bp, Homo sapiens
tgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgtaagtctggaagcacctggcgcccccaggccattgctgaggacgctgtggatatgcataagcagtcagtgactgccgaagcccccagattctgactaatgtgtgagattccaccattagagcttcattcctttgttagtttgttaaaaagcaaatctggttaggaaggtataacattaaagagtcatttatacattc

SEQ ID NO: 432908 - DNA, 7379 bp, Homo sapiens
atggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432909 - DNA, 7473 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtcctactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432910 - DNA, 6924 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttgagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432911 - DNA, 7506 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432912 - DNA, 755 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaaggtgagccagtccaggtcttgagcctcaagtttgatgatttctctctttgccctgtacctagcttgccaggccatgtgctgggcatcaggggatacgtgcatgcaaacaagggttctttctttagggagtcccttgggggagacacatgtaaaagaagattaattgaagaagttgtggtgttattacggagagatgaagtattgtggtagtttagatgactgagctgctggctaggggcaaattacaaaagctttgtagagtcggtgacatttcaactggatctttcgaaagaagttagccaagtaaaggagagggaagagagagattttgggtggcagaggctggatatgcaagtttgtagagtagatggtaagtagtgtccaataagggtggagagatgaattgtaaccagagtatgaaaagtcttgtatgccagtctgtagtttggattttctttaggaatagaaaaatcagtacagtactccaaagcagggcagtgatgtaatacgctttactt

SEQ ID NO: 432913 - DNA, 7527 bp, Homo sapiens
aaacagatgtgggagcagggacgagagttgtggagtttaagtaccatgctggacctgaggatatactgtgatggaaccgttcagtaggtacctgagaggctggagcctcaagagtctaaacagagatacagatttgggaatcatcgtccagtagtgattaaagtcacaaggtctaatagaaaaagcaaagaatactgccacgttttggggctctgtaacggatgctggagaaataaagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432914 - DNA, 5611 bp, Homo sapiens
gagagaaattaagaaggccctgatcattaaaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgttttctttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgaaaaaagtcagt

SEQ ID NO: 432915 - DNA, 203 bp, Homo sapiens
tcttttcaacatgttttcagagcctcccctcccggaagtagaattttttacggtgcacagaggacctctaccacgcctcagactgaggaaagccaaggagaaaaatggaccaatcagttcatatcaggtgttagtgctggcatccaaagaaagttctcttctcccccaccagatggaagcagcggaatctatcagcacgaacc

SEQ ID NO: 432916 - DNA, 3125 bp, Homo sapiens
gaggaaggacccgcgctctgcggcctcccggggaccccgcagcgccccccgcttccctcggcggcgccggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtattaa

SEQ ID NO: 432917 - DNA, 2778 bp, Homo sapiens
tcagaatcacagttgccagagaaacatcagcgggctttagctggggcagagcttagcaagtgttggggtatcagcagttagtcactgtttgcctggaaccacaggatgtgaatcctagttcctggattccaaggaatcctgcatccaggtgtttattgtgctttgcagagtcaacatcaagctcaggagctggttgcagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtattaa

SEQ ID NO: 432918 - DNA, 1039 bp, Homo sapiens
ggactatgagaatcgaacccatccctgagaatccaaaattctccgtgccacctatcacaccccatcccaaaaaaaaaaaaaaaaaaaaaaaaaaaaagcggccgctcgaattacggctgcgagaagacgacagaaggggctggttcttacttctcctggcccaggctgtgtggccccgtgtcctgcaggtattgggagatccacagctaagacaccgggacctcctggaagccatgattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtattaa

SEQ ID NO: 432919 - DNA, 825 bp, Homo sapiens
gcgctcgggttatggttgatattgctagggtggcgcttccaattaggtgcatgagtaggtggcctgaggtaatgttagcggttaggcgtacggccagggctattggttgaatgagtaggctgatggtttcgataataactagtatggggataaggggtgtaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtattaa

SEQ ID NO: 432920 - DNA, 141 bp, Homo sapiens
ttgtaaatgtccactaactacatgtgtctcatcttgcatttttctttttctgaaacatacaatttatgattcaggtttagacgtctgtgccacttgccatgaacatgccacatgccagcaaagagaagggaagaagatctg

SEQ ID NO: 432921 - DNA, 3279 bp, Homo sapiens
gaggaaggacccgcgctctgcggcctcccggggaccccgcagcgccccccgcttccctcggcggcgccggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtattaaaaaacacacaagagaatacatacaatcacaacacaaaaaagaagggggcgcccaaagatcccgcgcgggggccccatacggtccccccttctgtgaaaggggcccaaaaggggcattaaaaaggacgggcggtaaacagccggggggaacgcgc

SEQ ID NO: 432922 - DNA, 2124 bp, Homo sapiens
  misc_feature (2065)..(2065): n is a, c, g, or t
  misc_feature (2082)..(2082): n is a, c, g, or t
gaggaaggacccgcgctctgcggcctcccggggaccccgcagcgccccccgcttccctcggcggcgccggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaagaaggccatcacggacgctgccatgatggcggaggagctgaagaaggagcaggacaacagcgnccaccttgagcggatgnagaagaacctgggaacagacggtgaaggacctgcagcatcgt

SEQ ID NO: 432923 - DNA, 1296 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432924 - DNA, 1604 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacggagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432925 - DNA, 1355 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432926 - DNA, 1223 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432927 - DNA, 1192 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagaagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432928 - DNA, 1001 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaacca

SEQ ID NO: 432929 - DNA, 1050 bp, Homo sapiens
  misc_feature (871)..(871): n is a, c, g, or t
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccttctacctaagtcnagcatccggtggtgcggccccgagactgagaattcttaggtatgtcctgcgcattaagcaggctacgacggatatattagatctcgtgtagccctgcttgcagcgtcccgaagtcggtcggaagtgggctgctaactggcaaaaaccgtttgggcgataggctgccttagagcctacag

SEQ ID NO: 432930 - DNA, 1074 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaacca

SEQ ID NO: 432931 - DNA, 413 bp, Homo sapiens
  misc_feature (271)..(271): n is a, c, g, or t
  misc_feature (288)..(288): n is a, c, g, or t
  misc_feature (351)..(351): n is a, c, g, or t
  misc_feature (353)..(353): n is a, c, g, or t
  misc_feature (383)..(383): n is a, c, g, or t
  misc_feature (395)..(395): n is a, c, g, or t
  misc_feature (397)..(397): n is a, c, g, or t
  misc_feature (401)..(401): n is a, c, g, or t
  misc_feature (412)..(412): n is a, c, g, or t
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggncagggccgaattggggnctttcccattcccccacccacatgaacacacaccttaccaggctgaacagtgcagagaaagtngnagagcctgtcaggcaatggctgctcacgtntgtggaggagtngngggntacgtggtggna

SEQ ID NO: 432932 - DNA, 1656 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432933 - DNA, 1177 bp, Homo sapiens
gtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432934 - DNA, 1138 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432935 - DNA, 1242 bp, Homo sapiens
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagacccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaatat

SEQ ID NO: 432936 - DNA, 345 bp, Homo sapiens
gcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgt

SEQ ID NO: 432937 - DNA, 2008 bp, Homo sapiens
aaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgatctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaaaaaaaggcacaagagaaaaaccagaaagaaaaaaatagggagcacaacaagaagatagaaaagacagaataaatcagaaaaaaaaagaggggggcgaacacggagagcaaaaagtgaagagacagaagaaaggggataaacaaagagggagaaaagggggaaacac

SEQ ID NO: 432938 - DNA, 1915 bp, Homo sapiens
tgtagctaagatggacatgatacctcaagtggctgttacctaaatggctgtaccataatggctgattacctaaatggctgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaaaaaaaggcacaagagaaaaaccagaaagaaaaaaatagggagcacaacaagaagatagaaaagacagaataaatcagaaaaaaaaagaggggggcgaacacggagagcaaaaagtgaagagacagaagaaaggggataaacaaagagggagaaaagggggaaacac

SEQ ID NO: 432939 - DNA, 502 bp, Homo sapiens
tgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttat

SEQ ID NO: 432940 - DNA, 1572 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432941 - DNA, 2080 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacaggaaaaaaaaaaaaaaaaaaaaaaaaaaaaccctcaaaccatttaaacccggaaaacccccccttataaaaggccctccgggcaccccttctacaaaatttccacacggtatcgtgggtctcccgtgtctgtgctcccccccccaattttcccacaccccccccttcataccgcgattgccgactcttctttggcggcccttaattccacggttgttgtgtgcgccaatgttccggcctgttcggggatccttgggtccaccccgccacagcagactcttgcgaaacggttccttccacggggcgaccattgtgctcttcgtgtggcgctggttcttctgggaagtgtccccccctcgtgcgtgtgttacgacacttgcggggcattctgcggcggcctataggacctcgcggtagggggccccgcatgtcttgttccggggaattccgggtcgtggacctccgatgacggctgtccccctggcgtccggacgttggttccgggttcgccg

SEQ ID NO: 432942 - DNA, 1321 bp, Homo sapiens
tgaggaggaggcgaagcagcttgctgaggagatgaacatcgccttctacaccagccggactgatgacatcttgctgcatcaagatgtggatctggtgtgcatcagcatcccccctccactcacccggcagatatccgtgaaggctctagctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432943 - DNA, 1377 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccaggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432944 - DNA, 1399 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagagagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432945 - DNA, 1446 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432946 - DNA, 1017 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432947 - DNA, 1381 bp, Homo sapiens
cacggttgcccggcaacaacaagtcccgtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcggctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagaggaaggaccctaaggaccatgagaaggagaacctgaggcggatcagggagattcagaagcgcttcagagaacaggagcgcagccgggagcagggccagcccaggcccctgaaagctctgtggcgcaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432948 - DNA, 836 bp, Homo sapiens
  misc_feature (18)..(18): n is a, c, g, or t
  misc_feature (79)..(79): n is a, c, g, or t
  misc_feature (83)..(83): n is a, c, g, or t
  misc_feature (127)..(127): n is a, c, g, or t
  misc_feature (140)..(140): n is a, c, g, or t
actaccacgacacactgnacacagccactgggacagacctacaacacaaactcatactcacagagacgacacctccccncaanagaccactcgaacactccacaccacccaatagtaaaatagaccnaagaaaaaccccnccgggtcccgaagctaaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattacttgttggagcgcagggacctgtggcggcgggaggccgaggcccgcaagcagagccagccggaccctgccatgcccccaggccacacgcgcatgcctgagaaccagcggctggaaacactgaccaagctgctccagagccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacagga

SEQ ID NO: 432949 - DNA, 243 bp, Homo sapiens
gtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcgggtgagtccgggggcttggcggtggtgcgaggctcaggggtcggccctg

SEQ ID NO: 432950 - DNA, 2468 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtga

SEQ ID NO: 432951 - DNA, 2546 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtgactctgtattactttggtgcataaaagttgaacattgttgtttactgaaaataaaattaaaatttatgaattaaatgag

SEQ ID NO: 432952 - DNA, 2811 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtgaaaaaaaaacaaaaaacaaaaaaaaaaaaaaaacacaaaaaaaaaaaaaaaaaaacaaaaaactaccgaccgaacacccgaacaattagcctggagtagctgataatcaaaaacggagcaagccggtcgagcaatgtctaactggaacgcaactagctacaacagacgtgccctacgacaactggagcaaaaaattacgttcgtaggcccatacctatcggagagaggaagtgtaaaaacatgagcaggagtggcgatagcagtgtggtgaagaacagacacaagcgtaggagttaatacacgagtacgagtaatatgaatattgagcacacttcgagtactac

SEQ ID NO: 432953 - DNA, 2121 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagctatatctttatctctcagtgataacccgactcacaggtatat

SEQ ID NO: 432954 - DNA, 2247 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtga

SEQ ID NO: 432955 - DNA, 1644 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtga

SEQ ID NO: 432956 - DNA, 2091 bp, Homo sapiens
ccctcctccctgcactgcagccaaccggcttgtgcgcgtcccaggagcgcgctataaaacctgtgctgggcgtgatcggcaagcaccggaccaggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgcgtgactctgtattactttggtgcataaaagttgaacattgttgtttactgaaaataaaattaaaatttatgaattaaatgag

SEQ ID NO: 432957 - DNA, 2486 bp, Homo sapiens
atcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtggccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 432958 - DNA, 699 bp, Homo sapiens
  misc_feature (587)..(587): n is a, c, g, or t
  misc_feature (630)..(630): n is a, c, g, or t
  misc_feature (696)..(696): n is a, c, g, or t
atcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctggggcggtacgtgagatcggggtgtccttctngatcatgcaactgagtgaatgacattatcatgtgagagcaggnctgaagcacacagcaatgtcgaggtgcgggtcgaagagggtggcgagagagatggtgatgaggatngtg

SEQ ID NO: 432959 - DNA, 324 bp, Homo sapiens
tactttaaaattcaaatggaaccaaaaaagagcccccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 432960 - DNA, 2607 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgt

SEQ ID NO: 432961 - DNA, 3006 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432962 - DNA, 2613 bp, Homo sapiens
aatataggctaggtacgaggcctggtgttgaatcggccgaggagcggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgt

SEQ ID NO: 432963 - DNA, 1856 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 432964 - DNA, 2870 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432965 - DNA, 1317 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggtttttttttttccgagattgtgccattgcactccagcctgggcaacaagagcaaaactctgtctc

SEQ ID NO: 432966 - DNA, 1522 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatcccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 432967 - DNA, 2952 bp, Homo sapiens
atcgtgtgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432968 - DNA, 2801 bp, Homo sapiens
taaatgtttcccatcttctgcagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432969 - DNA, 3146 bp, Homo sapiens
agcctctttctttctgttcctgtggttttgaataccatttacatgactcacgtctcagattttctttccctaccagcctccctgtgttggtttgtgactttatctgtcagtgttctctcaggtatttacttagatttctgcaggcatcctcaaggtcagcgcatcagccaacttctgttgtttaacagaacccttctttgtgccctgactctatctccagttctttaggtacatgagttcagtgttgattcttgactgcttgctcccacacccatgcttggcagcctccaactttcttaagtcccatctatctccaatcagagaaatgttagccatctttcatggtcaacttcatattcagtggacaaggtctgaactgactagcaggactaacacgggcagctgttcgctcatccattgctcacttacacttgagtcattttgcttaccaaagaacccagtgtgtcctgggcaccaggctaggtgctttacacacatttatctcatccagtcctcactgcaatcctggaaggaggctgaagcactttaaaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432970 - DNA, 2647 bp, Homo sapiens
atcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccacctccacctcccaaggtgttgggattacaggcgtgagccaccgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattatccccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttca

SEQ ID NO: 432971 - DNA, 2011 bp, Homo sapiens
caacctttgcctcccgggttcaagcaattctcctgcctcagccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtca

SEQ ID NO: 432972 - DNA, 2599 bp, Homo sapiens
atcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccacctccacctcccaaggtgttgggattacaggcgtgagccaccgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattatccccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttca

SEQ ID NO: 432973 - DNA, 2221 bp, Homo sapiens
caccacacctagcggttcaaaatgaacatctgaagcaacgaaggtcacagaaaaatgcactatttatctaggtaatggagatgatgtcttttgccagagaaagcaggcgcacgcagatgagagtgtctggattcctttttgtcttcataaagcgaatcttggactgaaaaacagtccaagagctgttggagctgccgggccagctctaatgaggcgcccaggcaagcactcatgggccccacaggtaccacgcaattgaacccttgtttgtctgataacttgcagtgacgtttatgacatgtgctgtctccacatctctttaccccttggatttctctaggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccacctccacctcccaaggtgttgggattacaggcgtgagccaccgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattatccccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggcttca

SEQ ID NO: 432974 - DNA, 1124 bp, Homo sapiens
atcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggtaggtacctggtgttggtgcagttgtatctcctggcaggagcatggtacatactggttgaggttgtgggtaggatgagaagacgacaggatgaatcttaccccccagctttagtggaattctgtgaaacacctgggaatgtgttagcatcaggagaattcctctaaggtatgaagaatgacaacctgggacctttcttgtaggtggctctgaacctaactattccccaaagattcccaagtggtaggaaggagggggtgcagagggatattaatcatggtcattaagtctcaaaacatttctacttcaagtgaatacattaaccatgctgaggcagttgaacaactgaatgcgtagt

SEQ ID NO: 432975 - DNA, 333 bp, Homo sapiens
  misc_feature (322)..(322): n is a, c, g, or t
  misc_feature (333)..(333): n is a, c, g, or t
aatataggctaggtacgaggcctggtgttgaatcggccgaggagcggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaaggtttgatttggtggctctctactacaaactaatctaacccgcactatactacccccttactttttatatttgtgtggagactcaaaanagtgaacatcn

SEQ ID NO: 432976 - DNA, 848 bp, Homo sapiens
atcgatttgcatctgtatccgctgctccatctgcagtatacggacatgctccacttcacccacactgggtcattaaaagaacaaacaaaaataagaacttgatcgatttgggattttaaatggaaatgcactaaaaattccttaattccaccattcaccgtctaccatagaggaacagcccatctgcacggagagacagctacgtaattcactgcagcattataatactgaaaaattaaaatgaacgaaatgttccataaccgacgaacggccgaatgaccggcgtctccactccgcggaacgttctgcgagcgctaaggggatggcgggagtgcatgatttggagcgggcggtgagaaaagcaagctcccgccgcctctccgttttggcaacccggctgacggtcgtttcggcttctggggccagccgtcggtctgggcgagggacatagatccggattcgcatcctgactggccaaccaacgctggccgaggtgaccactctcctcggcatccgcacctgccctccaaggcgtcagagaggccggacccttgggtgctagggctcgtgagcgccggggccaagtttccgagtgccgctctcagcagcgcaccaaccggaagtgatcgtgtgtggcggaaggaggagctttctgggagtagccggtgctgagagaaccgtggctggcaaagatgattcaggcgattctggttttcaacaaccatgggaagccacggctagtccgcttctaccagcgtttcgtgagtgcggcccggcttcaccacgccccttcagggcgcccactatgtcttccctcctctttggcctctcggcgcccgggggcaccg

SEQ ID NO: 432977 - DNA, 2103 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatataacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtga

SEQ ID NO: 432978 - DNA, 821 bp, Homo sapiens
  misc_feature (751)..(751): n is a, c, g, or t
  misc_feature (758)..(758): n is a, c, g, or t
  misc_feature (818)..(818): n is a, c, g, or t
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggggattgtacccaaaanggggggnttccaaaaaaaagggttttgggggggggggtttttaaaaaaaagggggaaaaaagggggnaaa

SEQ ID NO: 432979 - DNA, 310 bp, Homo sapiens
atatcgtcgacccacgcgtccgcttaattcaaagagggtcaggacatgcagcttgtaataaaatggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtga

SEQ ID NO: 432980 - DNA, 588 bp, Homo sapiens
tttgtcattcaattccagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggatgcttcttgacgtcaagaagcatcctgagttaacttaaacaaagtacttgcaacagtgcctggcatgtagtcagcactattttatttatttatatttggagatggactttcaacatgtaggccaggctggtctcaaacttctgacctcaggtgattcatctgccttggcctcccaaaatgctgggattacaggcatgagccactacacctggacaattttcggctttcttgtactggaagtgggtcacttccagggctgtgcctccttttttatataattaggagacgagtctagctgggtcgcccaggttagagttgagtagtgccatcattggctcactgaagtcttgacctcccaggctcaattgattctcacacctccagctcacctccagctcctgagt

SEQ ID NO: 432981 - DNA, 2294 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatataacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtgaaatattagtaacaaattatttgggtatttaaacattaggaatcttttcaaagcatttttaataggaagaaatttttcttctagatgtatataggtgatgccatgattccttaattattttaattgacaaagctgaactcattaaatgactaaatgaagcttaagttttcttatgaaaccatcataaatcaa

SEQ ID NO: 432982 - DNA, 1758 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatga

SEQ ID NO: 432983 - DNA, 1985 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacaggtaagccatttttgtttataacttaaacttctagaatttgtttttggtatactttcttattttaaaaagatgattaatgaactgggcatttaaactcaagaataagaaatggaagacagaaagccagtgatggtaaaggataaaagggtaaactaatcggaaactatctcacgtgttttttttttttttttgcctctgcttaacactaaggcagagatagacttttcccagttttaggccatcagaaacctcatgggcaactttcccctttcactgtctttctagtttgttttccttgttggtcagacctgtttgagtaaattctcatagtaagttcttctcttccataacaaatagaacttaagctaaacactttttcagaatta

SEQ ID NO: 432984 - DNA, 1357 bp, Homo sapiens
  misc_feature (1307)..(1307): n is a, c, g, or t
  misc_feature (1313)..(1314): n is a, c, g, or t
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgngtttgnncatcgaatgaagtgttggcttccagaatggtaatcgaattcct

SEQ ID NO: 432985 - DNA, 1939 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatataacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtga

SEQ ID NO: 432986 - DNA, 1146 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcagtaagagctgatttttcggcttgaataatgagatgaattaatgagcccaacaattgcattttaaagctgtacaagtggaaaataggatattaatttgcttattgagtttagttctcagccacatcagttggccaccatggttat

SEQ ID NO: 432987 - DNA, 1168 bp, Homo sapiens
gaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtaattctagacagctatattttattactctcatgtttgtaccttaatataaatgtaattccattatatggcaaaactgtgttttaatgattaaattttttccaaagtaccacttggtggcttttaagactgctttaaacttttttaagaaaattacttctttcaacaaagtactgtataattgttctgtataatttttagtaatcctcatcaatagtctaacaaaataacacttgtttttctattatatgctacaagcaggagcatataatagaaaacatataaagacatgagttagctggggatagaattgtatcataggtagtcaccaagagttactaagaaactgctaaact

SEQ ID NO: 432988 - DNA, 1125 bp, Homo sapiens
  misc_feature (8)..(8): n is a, c, g, or t
tgcacacnccgagaacccagaccatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatataacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtga

SEQ ID NO: 432989 - DNA, 960 bp, Homo sapiens
tgacttttatatgttttcagaactacttagtgactacattcgtcttattgctgcagtgaaaggtgtgtttgaccatcgaatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatataacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtga

SEQ ID NO: 432990 - DNA, 2569 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432991 - DNA, 1770 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagtggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432992 - DNA, 3741 bp, Homo sapiens
gaggctgaggcaggagaattgcttgaacctaggaggcagaggttgcagtgagccgagaccgtgcctttgcactccagcctgggcgacagagtgagactccatctcaaaaacaaaaaaccttggcaaaatactgcaaataaccccattaaaaagagggcaaaagaagccgggcacggtggctcacacctgtaatcccagcactttgggaggccaaggtgggtggatcacgaggtcaggagattgagaccatcctggctaacacggtgaaaccccatctctactaaaaatacaaaaaattagctggatgtggtggcggacgtctatagtcccagctacttgggaggctgaggcaggagaatggtgtgaacccaggaggcagagggtgcagtgagctgagattgtgccactgcactccagcctgggcgacacggcaagactctgtctcaaaaaaaaacaaacaaaacaaaacaaaacaaaacaaaaaacagaaggcaaaagagttgaagaaacatttcactgaagaggatgtatagatggcaaataagcatataaggagatatgtaacattattagctatcagggaaatgcaaattaaagccacagtgagagaactacctcaggatgactaaaataaaaagtagtgaaaatacgaaatactggtgactgtgcagggaaactatgctcatggattgctgataggaatgtgaaatggtacagccactctggaaaacagatctggcagttaccatcctgggtatttatcccagagaaatgaaaactactctgtatacgttagccaggcatggtgatgcgtgcctgtaatcccagctactccggaggctgaggcacaagaattgcttgaacccgggaggcagaggttgcagtgagccaagattgtgccactatattccagcatgggcaatagaccaagaccctgtctcaaaaaaataaaaaataacttatctgtacatgaatgttaatagtagctttattggtaatagccagaaactggaaacaaatcaggtgttttcaacagtgaatggttaaacaagctgtggtagatacccatggaatactactgagcaatagaaaaggaaccaactattggtacatgttgagtaccctttatctgaaatgctggggaccagaagtgttttggatttcagattttttcagattttggaatctttgcattatagttactggttcagcatttcttatccaaaagtctgaaatgcatttcctttgagtgccgtgtttgtgctcaaaaagtctcagattttggaggtactcaacctgtacatgcaacaacctggtagaacctgggttggggtagaaagccaatgtcaaaaggttgtatactgatttaattcagacaacactcttgaagttacaaaactgtagaaatagagaagagattggtggtttccagggcttaaggaagggattagggtaagggaggtgagtggatgtcaccctaaagggcagcccctcgggatcctggtggtgataggacagttctgtggctgtgtccacgtcagcatcctggtgaccctgtgatatagtgacacaggctcctaccatgggggaaagaaggcacgtgagacctctgtatttttacttccaactacacgtgactacacttatctcaaaatgaaaagtttaattaaaaagaaaaacctcggctgggcgtggtggctcatgcctataatcctagcactttggaaggccgaggcaggtgggtcacgaggtcaggagatcgagaccatcctggccaacatggtgaaaccctgtctctattaaaaatacaaaagttagctgggtatggtggcgggcgcctataatcccagctactcgggaagctgaggcaggagaatcattcgaacccgggaggcggagattgcagtgagccgagatcgtgccactgcactccggcctggtgacagagcgagactccgtctcaaaaaaaaaaaaagaaaaacctccccagacccctactggtgataggagaagacccaaaccaaacccttggtgtgtgttcttcctccccactgctccgtccacctctctagactcttgtgtttttgccacccgcatggcctcagtgttagtgacttgcccagtaacatagctctggagcctccacaccctgaggggctcctctaccctcaaaacacccagggccttgccttggggccttctgttggcctgctgggtgtgagtgggtgggttccggaagtggtagggccagggtaagaggtgcccatgatgggggcaggctgggccctatggagatagcccaacagagggagggtaaaaagcccacagaaggttcaggaccagaatcaagaaccatgtgtatttttctccccacatcatgagtttagtgtcagatattatttacaaacattttaaaagcagggtcagcaggcccggaggattgcatgtccagtgggagtgggggaggggtggaggccactgagggtgggtcagcggtccccagggttctgtggcttcttccagactggcttggaaaaaatgcttttattttcttggagttcccccatgcagatgttaactttaggggcaaaggaaagacaaaggctacatttcatttctgagtctatagatgtatccgctattgggaagaggttagaggtcaatgactaggacagtatgtcccatgagaatcgagggaggattcttgtctgtatgtgagtgggaagtggtgaagcctcacagcgttgtcaggcaggtgtggggtggtgattggccttgacagagtacccagccacccttcctcactgccctctcacgccatttctcctggtggctccacacaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccagcaggtgagtggggcccggggcagtccacacccgtcatcattcccaagcctctcagttgttattgatggaaaatgtaattgaatcatgtgccttttaaaaatagactattttttagagcagttttaggttcacagcaaaattaagtggaaggtacagtttccatacacccccttttccccccatacacatatagcctccccactgcagacctctcgctccagaggggtggatgtgtcacagttgttgaaactgcattgatgcatcaccatcaaccagagtccacagtgttcactcttggcacattctataggtttggacaaatgtcaccatgacagtatcacacacatacacatctacctttgcttattactcttaaaaacttttaggccggatgtggtggcacatgcctgtaatccaagcagtttgggaagccaaggcgagaggatcacttgagctcaggagcttgagaccagcctgggcatcatggcaaaaccccatctctacaaaaatacaaaaattagccaggtgtggttgcatgcctgtactctcagctacttgggaggctgaggttgggggatggctggagcccaggaggcagaggtttcagtaagctgagatcacgccactgcactccagcctgggcgacagagccaggccttgtctc

SEQ ID NO: 432993 - DNA, 3188 bp, Homo sapiens
gcaagttttatatcagcatatatttttcattttttcttttaaagatatataatcatgtgccacacagtgatgtttccgtcaatgacagaccagaccacatgaaggatggtggtcccatatttttactgtaccttgtctgtgtttagatacacaaattccattgtgttacagttgcctatagtattcagtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432994 - DNA, 2439 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggagggtggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432995 - DNA, 2376 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432996 - DNA, 2426 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccagctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432997 - DNA, 2304 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432998 - DNA, 3997 bp, Homo sapiens
gaggctgaggcaggagaattgcttgaacctaggaggcagaggttgcagtgagccgagaccgtgcctttgcactccagcctgggcgacagagtgagactccatctcaaaaacaaaaaaccttggcaaaatactgcaaataaccccattaaaaagagggcaaaagaagccgggcacggtggctcacacctgtaatcccagcactttgggaggccaaggtgggtggatcacgaggtcaggagattgagaccatcctggctaacacggtgaaaccccatctctactaaaaatacaaaaaattagctggatgtggtggcggacgtctatagtcccagctacttgggaggctgaggcaggagaatggtgtgaacccaggaggcagagggtgcagtgagctgagattgtgccactgcactccagcctgggcgacacggcaagactctgtctcaaaaaaaaacaaacaaaacaaaacaaaacaaaacaaaaaacagaaggcaaaagagttgaagaaacatttcactgaagaggatgtatagatggcaaataagcatataaggagatatgtaacattattagctatcagggaaatgcaaattaaagccacagtgagagaactacctcaggatgactaaaataaaaagtagtgaaaatacgaaatactggtgactgtgcagggaaactatgctcatggattgctgataggaatgtgaaatggtacagccactctggaaaacagatctggcagttaccatcctgggtatttatcccagagaaatgaaaactactctgtatacgttagccaggcatggtgatgcgtgcctgtaatcccagctactccggaggctgaggcacaagaattgcttgaacccgggaggcagaggttgcagtgagccaagattgtgccactatattccagcatgggcaatagaccaagaccctgtctcaaaaaaataaaaaataacttatctgtacatgaatgttaatagtagctttattggtaatagccagaaactggaaacaaatcaggtgttttcaacagtgaatggttaaacaagctgtggtagatacccatggaatactactgagcaatagaaaaggaaccaactattggtacatgttgagtaccctttatctgaaatgctggggaccagaagtgttttggatttcagattttttcagattttggaatctttgcattatagttactggttcagcatttcttatccaaaagtctgaaatgcatttcctttgagtgccgtgtttgtgctcaaaaagtctcagattttggaggtactcaacctgtacatgcaacaacctggtagaacctgggttggggtagaaagccaatgtcaaaaggttgtatactgatttaattcagacaacactcttgaagttacaaaactgtagaaatagagaagagattggtggtttccagggcttaaggaagggattagggtaagggaggtgagtggatgtcaccctaaagggcagcccctcgggatcctggtggtgataggacagttctgtggctgtgtccacgtcagcatcctggtgaccctgtgatatagtgacacaggctcctaccatgggggaaagaaggcacgtgagacctctgtatttttacttccaactacacgtgactacacttatctcaaaatgaaaagtttaattaaaaagaaaaacctcggctgggcgtggtggctcatgcctataatcctagcactttggaaggccgaggcaggtgggtcacgaggtcaggagatcgagaccatcctggccaacatggtgaaaccctgtctctattaaaaatacaaaagttagctgggtatggtggcgggcgcctataatcccagctactcgggaagctgaggcaggagaatcattcgaacccgggaggcggagattgcagtgagccgagatcgtgccactgcactccggcctggtgacagagcgagactccgtctcaaaaaaaaaaaaagaaaaacctccccagacccctactggtgataggagaagacccaaaccaaacccttggtgtgtgttcttcctccccactgctccgtccacctctctagactcttgtgtttttgccacccgcatggcctcagtgttagtgacttgcccagtaacatagctctggagcctccacaccctgaggggctcctctaccctcaaaacacccagggccttgccttggggccttctgttggcctgctgggtgtgagtgggtgggttccggaagtggtagggccagggtaagaggtgcccatgatgggggcaggctgggccctatggagatagcccaacagagggagggtaaaaagcccacagaaggttcaggaccagaatcaagaaccatgtgtatttttctccccacatcatgagtttagtgtcagatattatttacaaacattttaaaagcagggtcagcaggcccggaggattgcatgtccagtgggagtgggggaggggtggaggccactgagggtgggtcagcggtccccagggttctgtggcttcttccagactggcttggaaaaaatgcttttattttcttggagttcccccatgcagatgttaactttaggggcaaaggaaagacaaaggctacatttcatttctgagtctatagatgtatccgctattgggaagaggttagaggtcaatgactaggacagtatgtcccatgagaatcgagggaggattcttgtctgtatgtgagtgggaagtggtgaagcctcacagcgttgtcaggcaggtgtggggtggtgattggccttgacagagtacccagccacccttcctcactgccctctcacgccatttctcctggtggctccacacaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 432999 - DNA, 2303 bp, Homo sapiens
gcaagttttatatcagcatatatttttcattttttcttttaaagatatataatcatgtgccacacagtgatgtttccgtcaatgacagaccagaccacatgaaggatggtggtcccatatttttactgtaccttgtctgtgtttagatacacaaattccattgtgttacagttgcctatagtattcagtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 433000 - DNA, 1559 bp, Homo sapiens
  misc_feature (38)..(38): n is a, c, g, or t
agcccacaacgcactggaagtccgaccgcagctccgtntgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtccaaggatttcgagcagagtcccgatgctgggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 433001 - DNA, 2313 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccagcaggtgagtggggcccggggcagtccacacccgtcatcattcccaagcctctcagttgttattgatggaaaatgtaattgaatcatgtgccttttaaaaatagactattttttagagcagttttaggttcacagcaaaattaagtggaaggtacagtttccatacacccccttttccccccatacacatatagcctccccactgcagacctctcgctccagaggggtggatgtgtcacagttgttgaaactgcattgatgcatcaccatcaaccagagtccacagtgttcactcttggcacattctataggtttggacaaatgtcaccatgacagtatcacacacatacacatctacctttgcttattactcttaaaaacttttaggccggatgtggtggcacatgcctgtaatccaagcagtttgggaagccaaggcgagaggatcacttgagctcaggagcttgagaccagcctgggcatcatggcaaaaccccatctctacaaaaatacaaaaattagccaggtgtggttgcatgcctgtactctcagctacttgggaggctgaggttgggggatggctggagcccaggaggcagaggtttcagtaagctgagatcacgccactgcactccagcctgggcgacagagccaggccttgtctc

SEQ ID NO: 433002 - DNA, 1845 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacactttggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgttaaaaaaaaaaaaaaaacactaaaaccaagtcagaaactgttcaacctcaacacccccgtaaatactgatgctccatataattgagctttttacacctaattgtttcatctatcgccctataatagaactaacggtcgtccatgttcattcgctgcgcgct

SEQ ID NO: 433003 - DNA, 1088 bp, Homo sapiens
ctggcccatggacaggatgtttcaacactggccctgtgccatccttccagggggcctgacctgtcagaatggtgggtaactgttgccaccttggtcagtgggcttgtgggggagctggcagcctcgtcccagtgggtgctgggctttattctagccttggctttgcaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 433004 - DNA, 1657 bp, Homo sapiens
cccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggagctggggaagcagcagttctccagcttggccacagaggggcagccttggctttcaaccagctgcatcgtggctgccggtgttccttcatgcacgcattcattccgcaactactaagcaccatgtaccaagtcctgggaatccagtggtgacaagaaatgagaaagactccccactccatggtgtttacagccttgtaggagaaaccactcttaaccagaaaacagatcagtaaagtggttaca

SEQ ID NO: 433005 - DNA, 1542 bp, Homo sapiens
gcaagttttatatcagcatatatttttcattttttcttttaaagatatataatcatgtgccacacagtgatgtttccgtcaatgacagaccagaccacatgaaggatggtggtcccatatttttactgtaccttgtctgtgtttagatacacaaattccattgtgttacagttgcctatagtattcagtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcaggtgaggcatgtctcatctagcaaggcagacccacacccaggtggggttccctgagatgcccatgatgcctgccgggcactagcattggcttgaagatgggtcaggaatgtgaggagaccaagcagtgacgaaggccatgaagtggggaagactctggagttgttcctggagctcaagcagagccgctctagacaccccaggcctctgcctttgccctcttctctattgctggttgtttccccactgtctgagtctccctgtcattgaaagcatcctgcacataagcaggtaggctgacccgaggctgcatgtggacgtcctgtgtgctctggggtctggcaatggggagcatccaccagcattgctgccagggcccttcctgcctgtcccctcactgggccacttcagtctcttgaaaac

SEQ ID NO: 433006 - DNA, 2993 bp, Homo sapiens
cggaatctggccagcgggtgtacctggctgagtctctgtggccgcggagcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtccgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacactggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatg

SEQ ID NO: 433007 - DNA, 3089 bp, Homo sapiens
cggaatctggccagcgggtgtacctggctgagtctctgtggccgcggagcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtccgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacactggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatg

SEQ ID NO: 433008 - DNA, 2707 bp, Homo sapiens
ctgcatcttttccatgtcacctaatgtaattgcatccaattgaacagggtgtgtgttatttcagggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacactggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatg

SEQ ID NO: 433009 - DNA, 970 bp, Homo sapiens
cggaatctggccagcgggtgtacctggctgagtctctgtggccgcggagcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtccgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggcctgtaactcacatgggaggtctaaactggaaatacataaagacaccttattgtattcgtggaagctcagagtgtgaccaactggaaccctcaagaggaccgaggtgaggactcaggttaatgaaaggaaaggacacacggtggagaaaggctgttgtgctaaagaaacgagagaaagttaggagtggatttctccccctgtgagtttgttcctttgtcagagatcagttgactatatttatatgggtctatttctgggctctttattgagttctattgatctatttgttgtttcactaataccacactgccacactgtcttgatttttgtagctttgtaataagtctttttttatttttttgagacagagcgagactcaacaacaacaacaaaataaaaatagctaggcatggtggctgatgcctgtaatcccagcactttgggagactgaagccaggagtttgagaccagcctgggcaacgcagagaccttgcctatacaaaacaacaacaacaacaaaaaa

SEQ ID NO: 433010 - DNA, 442 bp, Homo sapiens
aattattgatggagtgaaccagaggggagtctttacaagtgatttgattgccaaatcctttgccctcggtgagtggtgttgacgacgttgccggatgtggtgctctaccattgagctatacagccggagactaggaatgctattggaagagggaccctgggaatgactttcgcaggtgttgaatatccaatgcctgtatttcagcctgtaactcacatgggaggtctaaactggaaatacataaagacaccttattgtattcgtggaagctcagagtgtgaccaactggaaccctcaagaggaccgaggtgaggactcaggttaatgaaaggaaaggacacacggtggagaaaggctgttgtgctaaagaaacgagagaaagttaggagtggatttctccccctgtgagtttgttcctttgtcagagatcagttgactatat

SEQ ID NO: 433011 - DNA, 1359 bp, Homo sapiens
cagcaggtctcacagagtttgctctttaatactctccccagcacacggaaggggaagggggtggaggttgctgctatgagagagaaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgacca

SEQ ID NO: 433012 - DNA, 536 bp, Homo sapiens
gacaaaggagaaagtcctgtggagcctgcagagccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgacca

SEQ ID NO: 433013 - DNA, 1281 bp, Homo sapiens
cccttattcccaaaaaaaaggggtttttggggggcttttttggccccaaacccctttggaaaaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgacca

SEQ ID NO: 433014 - DNA, 1471 bp, Homo sapiens
cagcaggtctcacagagtttgctctttaatactctccccagcacacggaaggggaagggggtggaggttgctgctatgagagagaaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaactggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgacca

SEQ ID NO: 433015 - DNA, 507 bp, Homo sapiens
gaggcccgaggggcggcccaggactcgaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtcaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctgatgaggttccttcagttctagcttaacatttgttcttccatgatcaccagaagactcctc

SEQ ID NO: 433016 - DNA, 869 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgacggtgagtgcccacgcccttgcgcgcacctttcccacggcctggcggcgcccccttcggttttgtgctgtcagctgcacgttcactacccagacggaagccaaatttcacctgagacggcaggatagtcaccaccagcctcctgaagagcagagtgttgctctgtttctgtttctgtcttttaaagaacagacctgagtaaggatatttggaagccagtatagcccc

SEQ ID NO: 433017 - DNA, 2395 bp, Homo sapiens
ctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433018 - DNA, 1668 bp, Homo sapiens
ctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtg

SEQ ID NO: 433019 - DNA, 2813 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433020 - DNA, 2347 bp, Homo sapiens
gacaaccacaaacacacagaacaattacggtcaggtacgaggctgcgtgggttacagcagcggctccgagggcgcggcggagatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433021 - DNA, 2301 bp, Homo sapiens
ctgggacgcggttcagctcattccctgaggccggcccgcgtcccgtcaggcgccgcgcggggttagcgcggggtcagcggaggtcagcgggggtcagcagcagcggctccgagggcgcggcggacgcagaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433022 - DNA, 1679 bp, Homo sapiens
ctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtattgcctgttggatctattattcggctatctcccatgtgtaaccctttatggttgaaggtgttcataaatctttatcaaa

SEQ ID NO: 433023 - DNA, 2301 bp, Homo sapiens
tgtctgggtgcggttataaagtaggcactgcttgcgcacattgtcatagctgatgtcctgacccagcttatcttgtgcatccgtgagtacagtctgccggatctccctagtagatagaactcagtcattactttcgataacgccaggtctcagacctgacacttaaatgaatcggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433024 - DNA, 2865 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgtgagagctagggaaggacgaccaactgatgaacagacgaggaacctcttgtggagcaagaaatctatcatatgaataatagaatgcaaggccaatgaacatccatttcactcattaattctcaagacagtcaggtctatctcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433025 - DNA, 2742 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433026 - DNA, 2883 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacacaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433027 - DNA, 1181 bp, Homo sapiens
  misc_feature (954)..(956): n is a, c, g, or t
  misc_feature (959)..(959): n is a, c, g, or t
  misc_feature (969)..(970): n is a, c, g, or t
  misc_feature (972)..(972): n is a, c, g, or t
ctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggctnnnggncttccacggnnanggggctttaggccttggggttaagagacgtggatgtggcacagcgaggtggggtataaacgtgacgtgatgcggtgtcccaaagacatgtgtgttctgcatcgcaccgatgtgttatacacatcgtaatgcagtgccgtctcgcgggttctctgtccggcgccccaaaaaataagaaaaaagaataaagtaaaatagaaatagaaaaaa

SEQ ID NO: 433028 - DNA, 1661 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacacaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggccttccccatgccttgcttgaatccttgcgcggcgcggtcgggggttttggcgttttggcgctctttagggggggggggttttccttttcctttagttttgtaccccttcttgtggggtcttggtctcccttccgcgaccagaaccaaaaaacgcgtttttgttcccccctttcccgcttaaaactttggctttccccttcgcgggcaacaacgacaaacggccccggcttaaacgggtggggcccaaatgttttccccccgggcgggcaacagcggggcccgcttttttcttgggcggcacagcggccggggccgggaaaccgggtttccttttgggggcggccccaaaaggagccccccacccacggggggg

SEQ ID NO: 433029 - DNA, 1923 bp, Homo sapiens
ttctgagagtcccgggcccacaggcaggacagggccagacgtgggggctgctcctcacggccttacctcccccagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433030 - DNA, 2769 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatccaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggaaaaaaaaaaagagaaaaaaaaaacaaagaaaacaaagaaaagaaaaataaaaaaaaaaaaaagaaagaagaggggggcggcgcgcgcgccacaagagaggctatctctcccacgagggggcgcgcgaccatgctgctcgcgcgcgcgcgccccgcgcggttttctgtgggagacaacggggcgcgcccattatagagggggagcgcgcgattatatatataagagcacgagagcgagcggcgggcgcgcggagggtttcaaacacaagcggggagagagcgggggagagaaaacgcggagagcacccgcggagagcgcctcttgaggggaagaggagacccttaactaatgcgggggggggggggagcgaaaaatattgagtgggggggcgaacaaaacatcacctctagcgaggagaagtttaataaaggcgtctctagagggggggacaaatatataataaacaatatatgcaaagaggggtgtatatccagggggtgtgtgaaaaaacaataaagggggtgaaaatatggtgattgtgaggaggtgagtaaaaaaaaatttgtgggggaaaattagggggggtgagtatatagtaatatgtaaaaagaaacaaatattatattttaccccggggggggggttatgatgtttatgaatataaaaggtga

SEQ ID NO: 433031 - DNA, 1025 bp, Homo sapiens
cgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccaggggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtcaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctgatgaggttccttcagttctagcttaacatttgttcttccatgatcaccagaagactcctc

SEQ ID NO: 433032 - DNA, 2851 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaat

SEQ ID NO: 433033 - DNA, 2882 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433034 - DNA, 2822 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433035 - DNA, 2771 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaagaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433036 - DNA, 2270 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttaggtaagcaatgccagtagggatgagtgatggaccatcagctgtttttacgt

SEQ ID NO: 433037 - DNA, 1323 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaaggtagaggcttaaattgttcaggattaggaatttaacttttaaaaataaacttaaggctggacgcagtggctcgtgcctgtaatcccagcactttgggaggccgaggcgggcggattgcctgaggtcaggagttcaagaccagtctggccaacatggtgaaaccctgtgtctactaaaaatacaaaaaaattagtcaggtgtggttgcaggcacctgtaatcccagccactcaggaggctgaggcaggggagttgcttgaaccagggaggtggaggttgcagtgaaccgagattgcactactgcactctagtctgggcagcagagcaagactctatctcaaaaataaataaataaaaataaaataaaataataaacttaaaaa

SEQ ID NO: 433038 - DNA, 887 bp, Homo sapiens
gatttctggcacacgacaaagtggtgaggcacttagtgatggaatctcgtatcatttcggtactaccatgagggaattaaatttgtcactatgaatcgtgttctgggccctacatcagcctctgaaacgacacattatttctgtctagaatattttcccatctcttcttcaccgaacattggttaaactctctttcagaataccaactataactgttctaaaagtgttttctaaccaacttcatgtgtatctagcagttttaatcactctgcattataatcaactgattattttgcatacacgtgcatattgtgaatgtgttgaagttcagagctgactcctctcaactgaattctgtaggagtagcaagtctttattaccttccattgcactgagctcatttagttgtttcattcattccttcatgtgtcccataggggatacagaggcaggtaagacacagtgcctgccctcagtgtacagtgggcctttggtaaaaattggtttattggctaatccacaaattgctttttctttctctaggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaa

SEQ ID NO: 433039 - DNA, 2747 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttata

SEQ ID NO: 433040 - DNA, 2822 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433041 - DNA, 2843 bp, Homo sapiens
gtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433042 - DNA, 1002 bp, Homo sapiens
atgactttcattttatgtaagaattttgtgaacactttctctttcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagaaaaatatgcatttttcttttctaaa

SEQ ID NO: 433043 - DNA, 1406 bp, Homo sapiens
ttctacgtcgctgactcgtgacctgaccggtatcctaaactgggatcttgggtaggaggaagaaaagataaggagttcctctatctgaaattagtcgggctgttttgaggagtactggttagataccttccgatactcctccaaagaactctcggattcaagtaaacaaacatccattaatacaagttaagtatgttccaggcgctgtgtgttccaggtactgttaacaaaagcgggttactagttaagacttccttcatgccctggcgcctctgctcagccagttcccttcgcctaggaggacctctctacaccaccccgctatattccctccccggaattccttcccaaccttcaaggaccatctgccccaactagtggcgaacatcgaggctgtcgtgactgtgtagatacttatttgacctgctcccttggcaaacacttgaaacgcaatacatgtttgtggaactgaacatagcctgtgcatgcagcaaggcttctttccctggaatcgcctgcccttcctccaacacagcgaccagccggtcagaatcccaacccctcgactccggaaatgatctgagagacggaacttccgaacgtcgcaatcagatttgggcgggctaggagggtttgggtcttcaggtcacatctggacggagagacctccggggcctccgttggtcggtccttccgctccggataccgttccggatgtcaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttga

SEQ ID NO: 433044 - DNA, 542 bp, Homo sapiens
ggctgcaggaattcggcacgaggaattttaggacactctctatttcaagcttctttttcctactttttatttcagtgatatttaggacactctctatttcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcacca

SEQ ID NO: 433045 - DNA, 1330 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtggggtgaatcacctggaggtccggaggttcaagaccagcctggtcaatgtgaaaaaccc

SEQ ID NO: 433046 - DNA, 547 bp, Homo sapiens
  misc_feature (545)..(547): n is a, c, g, or t
ggaaggattcatttaacttctctgaacctcagtttcaactacaaaaagggaagaatagcttctctgtctcacaaaaataatgatgtgaaagtgttttgtgaaaatgtcacacttttacaaatgccaggttttcacatgcgtctctgaagagtgtggtttttttccctctccttaagtctgatcaccatttcctcttagtttcagttttgacttttatttgccctgcagcccggtgagggcacagactggttcatgtgctgtgattctccctgagtcatccttgctccctccctcctcattctcttttcatttcctgggcttgtgttgctacgttagaagtctgtctgtctcctggaaagggcagagcaagtccactgtggtaaggcttgtattttactttctccgtcgtcacatgataaatacttcttgtgaaagatttacttttagattccataaaagattactggagggaatgtcatctgtctattgtaatatttaagtattttgaataaaattaatctttgtcattttctcttgaaaaaaannn

SEQ ID NO: 433047 - DNA, 688 bp, Homo sapiens
ttctacgtcgctgactcgtgacctgaccggtatcctaaactgggatcttgggtaggaggaagaaaagataaggagttcctctatctgaaattagtcgggctgttttgaggagtactggttaggtatattggagaatgtgcctttattggaatttttcgcataattacacagggttatgggcttaggggtacatgattgttggccgggcgtggtggctcacgcctgcaatccggagactttgggagaccaaggcgggtgtatcgcttgacctcaagttcgagaccaggctggacaacatagaggaaccccgtctctaccaaaagaaaaaaaaaagggggatacatgatttctgactattcatgtcaaccttgattacctgaataaagtgtagggtttgtaggtttctccactctgaagttaccttttttaaccccctttccatactgtagtcttaggaaggaagccactatacaaagcccacacctagggagtgggaagctatgctcaacttccttattagggtggagcagctacataatttatttggaacttttctgagatagcctatatatttttcaaaagccttcccaggtcccatttagaggaatattaggacagaaatccccccaggctcatttgtttttatttggatttacctcaagcccgtttttttccccaaaatcccaaa

SEQ ID NO: 433048 - DNA, 463 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaagagtctctctcttgcccaggctggtgtgcagtgttgagaacacagctccctacagcctctacctgttgggctcaagcaattctcccatctcagcttcctgagtagctggaccacaggtgcgcaccaccatgcccagcta

SEQ ID NO: 433049 - DNA, 3347 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433050 - DNA, 3311 bp, Homo sapiens
acgaaggcacgccggggtgacctcaccctccaacatggcggcggcggtagattagggccgcgggtcggagcactcaccgccgctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433051 - DNA, 3914 bp, Homo sapiens
ttctacgtcgctgactcgtgacctgaccggtatcctaaactgggatcttgggtaggaggaagaaaagataaggagttcctctatctgaaattagtcgggctgttttgaggagtactggttagataccttccgatactcctccaaagaactctcggattcaagtaaacaaacatccattaatacaagttaagtatgttccaggcgctgtgtgttccaggtactgttaacaaaagcgggttactagttaagacttccttcatgccctggcgcctctgctcagccagttcccttcgcctaggaggacctctctacaccaccccgctatattccctccccggaattccttcccaaccttcaaggaccatctgccccaactagtggcgaacatcgaggctgtcgtgactgtgtagatacttatttgacctgctcccttggcaaacacttgaaacgcaatacatgtttgtggaactgaacatagcctgtgcatgcagcaaggcttctttccctggaatcgcctgcccttcctccaacacagcgaccagccggtcagaatcccaacccctcgactccggaaatgatctgagagacggaacttccgaacgtcgcaatcagatttgggcgggctaggagggtttgggtcttcaggtcacatctggacggagagacctccggggcctccgttggtcggtccttccgctccggataccgttccggatgtcaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433052 - DNA, 5040 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433053 - DNA, 3265 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcacca

SEQ ID NO: 433054 - DNA, 3190 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaaggccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433055 - DNA, 4826 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433056 - DNA, 4571 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433057 - DNA, 4293 bp, Homo sapiens
gagacaagtgttgctcagtcgcccaggctggagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433058 - DNA, 3912 bp, Homo sapiens
ctgctttagcgagagagggtttacttaggaagaattgggataggaattcccagctgagagaacttagctgtgggctcctcagctactgacttcttagctcttactcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433059 - DNA, 2635 bp, Homo sapiens
ttcctacatagaccatcacctaaagactagaacgaaccacgcgttacactcgacacgagggatatcctgacgccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433060 - DNA, 1203 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagggccacgacgtcactatgcagggcacacgtggcttggtttaaaaaggtcatcttagatttatcttagtaaatgtaataaattattttttagatcttgaaatttataataaaaatactttacctaccctgatcacca

SEQ ID NO: 433061 - DNA, 348 bp, Homo sapiens
aaaaaaaaaaaaaaaagtgctattatattctaatggtttctctctccctctttcaataataaccttttttgttgctttcaggggttcaactagatatagcttcacaatctctggatcaagaaattttattaaaagttaaaactgaaattgaagaagagctaaaatctctggacaaagaaatttctgaaggtctgtttattcttatttttctagttaataagcagattgtgtttgttatggtttactgttggtttaatttgatttttacagtggggtattctcaacagttaacaacttacaccaattatacattggtagaagtttataagggtaaaactagaaggtagc

SEQ ID NO: 433062 - DNA, 3426 bp, Homo sapiens
acgaaggcacgccggggtgacctcaccctccaacatggcggcggcggtagattagggccgcgggtcggagcactcaccgccgctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaagagtctctctcttgcccaggctggtgtgcagtgttgagaacacagctccctacagcctctacctgttgggctcaagcaattctcccatctcagcttcctgagtagctggaccacaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433063 - DNA, 4771 bp, Homo sapiens
aaaccccacagcctaattcctcctcaacctgggaaattcctatccccaatccttccctaaattaaacccctcctcctcgctaaagcagtgggtcctccaataggggatgttccacacgggacatttggccaatgtctagagacattttcgtttgtcatctctgggagggggtccactggcatctagtgggtggagcccaccacacacaggacagccccaacacagagaatggtcagaacagcactagtgccaaggctgagaaacccggtcctggagggggtgctttacccctaagattctcaatttagcatgagcggaggcccttgggatttacagtcagatgaatgtgaatgccccacctcaagccctaacatgcctaacatgccactgccatgttgagcagaagtccccaattatcccagagtgttccacaaatgtccagacagctgctggaggttcaaattccagccaatacaactccaaccttacaatccgtctgtctgtctcctggaaagggcagagcaagtccactgtgggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433064 - DNA, 3277 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433065 - DNA, 3120 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattgg

SEQ ID NO: 433066 - DNA, 3233 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaaggggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcacca

SEQ ID NO: 433067 - DNA, 4717 bp, Homo sapiens
aaaccccacagcctaattcctcctcaacctgggaaattcctatccccaatccttccctaaattaaacccctcctcctcgctaaagcagtgggtcctccaataggggatgttccacacgggacatttggccaatgtctagagacattttcgtttgtcatctctgggagggggtccactggcatctagtgggtggagcccaccacacacaggacagccccaacacagagaatggtcagaacagcactagtgccaaggctgagaaacccggtcctggagggggtgctttacccctaagattctcaatttagcatgagcggaggcccttgggatttacagtcagatgaatgtgaatgccccacctcaagccctaacatgcctaacatgccactgccatgttgagcagaagtccccaattatcccagagtgttccacaaatgtccagacagctgctggaggttcaaattccagccaatacaactccaaccttacaatccgtctgtctgtctcctggaaagggcagagcaagtccactgtgggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgtctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 433068 - DNA, 1400 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtggggtgaatcacctggaggtccggaggttcaagaccagcctggtcaatgtgaaaaaccc

SEQ ID NO: 433069 - DNA, 1221 bp, Homo sapiens
acgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggccacgacgtcactatgcagggcacacgtggcttggtttaaaaaggtcatcttagatttatcttagtaaatgtaataaattattttttagatcttgaaatttataataaaaatactttacctaccctgatcacca

SEQ ID NO: 433070 - DNA, 578 bp, Homo sapiens
ttaatttttcttgcgcacatatagaaatgaatagaaatattcccatttcaatatgcaaattcagccactatatagtttgtttctttttggtagctaataataataaatttttaagtaagatctgattttgaaatatgaaaagaagtttatcctttcctgttttaataccacctgatacccgtttaacttactgtgtttgattcttggggacatttatgttcaaggttctgtcaaagcaatctattattcttgtttttacctgatggatcatggagaaaaataatggattcagttatgagaaacagtaatagatttttttaactgccataaatttctctccctgtattaaataaaaggatcaggaaaagataagttgaattttcctacaatgagccagctcttcttaaatttacctcccataaattgtagcaaagcacttttcatataatgttttatttatgtaattcagttatttggagatggtggtgagggatgtgagtacatcatttcatgttgtatttcaaatctcttttgacagaaaccctaagaatttgcaataaagaaaattcaatgttcca

SEQ ID NO: 433071 - DNA, 1247 bp, Homo sapiens
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaa

SEQ ID NO: 433072 - DNA, 1108 bp, Homo sapiens
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaaccta

SEQ ID NO: 433073 - DNA, 1452 bp, Homo sapiens
tggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaa

SEQ ID NO: 433074 - DNA, 971 bp, Homo sapiens
  misc_feature (792)..(792): n is a, c, g, or t
  misc_feature (798)..(798): n is a, c, g, or t
  misc_feature (802)..(802): n is a, c, g, or t
  misc_feature (811)..(811): n is a, c, g, or t
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacattggggggnagaaangggntttaaacanggggtggttctaaagagagaaagcgtgttttaaccaaattgggggggctttcacctgggaggattgttgtgtgtttggcgccacggtatataagaggagtgttactcttgggcggggagaacaatatataatggcggcgagaaaacgaacatttgtgcgg

SEQ ID NO: 433075 - DNA, 1498 bp, Homo sapiens
tatacaggttgttctttcatgtttaacactgaatgttaaaatggtaaattgcaaataaataaataaataaataaataaaatgcttaattgtttagtattttaggtgaatggttatcaatacattcactggaaactttttacctaacattatgttagaaaaatgtaaatatgccataaagctaatggcaaatgttcctctttggattgtgaagtcatctagttatttatacttacaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaaaaaaaaaata

SEQ ID NO: 433076 - DNA, 893 bp, Homo sapiens
tcagaggatccccctgatattctggttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaaaaaaaaaata

SEQ ID NO: 433077 - DNA, 1006 bp, Homo sapiens
  misc_feature (547)..(548): n is a, c, g, or t
  misc_feature (554)..(554): n is a, c, g, or t
  misc_feature (560)..(560): n is a, c, g, or t
  misc_feature (577)..(577): n is a, c, g, or t
  misc_feature (581)..(581): n is a, c, g, or t
  misc_feature (585)..(585): n is a, c, g, or t
  misc_feature (598)..(599): n is a, c, g, or t
  misc_feature (602)..(602): n is a, c, g, or t
  misc_feature (604)..(604): n is a, c, g, or t
  misc_feature (607)..(608): n is a, c, g, or t
  misc_feature (613)..(613): n is a, c, g, or t
  misc_feature (615)..(615): n is a, c, g, or t
  misc_feature (618)..(618): n is a, c, g, or t
  misc_feature (620)..(620): n is a, c, g, or t
  misc_feature (622)..(622): n is a, c, g, or t
  misc_feature (624)..(624): n is a, c, g, or t
  misc_feature (626)..(626): n is a, c, g, or t
  misc_feature (630)..(630): n is a, c, g, or t
  misc_feature (633)..(633): n is a, c, g, or t
  misc_feature (641)..(641): n is a, c, g, or t
  misc_feature (661)..(661): n is a, c, g, or t
  misc_feature (669)..(669): n is a, c, g, or t
  misc_feature (690)..(691): n is a, c, g, or t
  misc_feature (697)..(697): n is a, c, g, or t
  misc_feature (706)..(707): n is a, c, g, or t
  misc_feature (717)..(717): n is a, c, g, or t
  misc_feature (720)..(720): n is a, c, g, or t
  misc_feature (728)..(728): n is a, c, g, or t
  misc_feature (738)..(738): n is a, c, g, or t
  misc_feature (743)..(743): n is a, c, g, or t
  misc_feature (745)..(745): n is a, c, g, or t
  misc_feature (762)..(762): n is a, c, g, or t
  misc_feature (771)..(771): n is a, c, g, or t
  misc_feature (774)..(774): n is a, c, g, or t
  misc_feature (782)..(782): n is a, c, g, or t
  misc_feature (784)..(784): n is a, c, g, or t
  misc_feature (790)..(791): n is a, c, g, or t
  misc_feature (799)..(799): n is a, c, g, or t
  misc_feature (802)..(802): n is a, c, g, or t
  misc_feature (805)..(805): n is a, c, g, or t
  misc_feature (816)..(816): n is a, c, g, or t
  misc_feature (847)..(847): n is a, c, g, or t
  misc_feature (862)..(862): n is a, c, g, or t
  misc_feature (868)..(869): n is a, c, g, or t
  misc_feature (872)..(873): n is a, c, g, or t
  misc_feature (881)..(881): n is a, c, g, or t
  misc_feature (896)..(896): n is a, c, g, or t
  misc_feature (924)..(924): n is a, c, g, or t
  misc_feature (944)..(944): n is a, c, g, or t
  misc_feature (1001)..(1001): n is a, c, g, or t
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaaannaaaaanaaaaanaaaaaaagcaaaatatngaanaacncactgaagatctnntananaannccaanancancnancngnaatngangccagcgngacaggggaccaaccaaaanacggcgcnggagggaaacaacgcaagacnnagaaangcggcggcnnccaacggagngangacagaanaaagggcggnggggngnagcaagggagaaggccnaaagcaacnccncaaacgananatgccnnggaggaanaanagncgggaggaatnaaaagcagcgaggcagggggagaaagcccancaggcagggaggggnaaatannagnngcccacancaggaggagcaaaangagggctcaaatcggaagcggagcagcncatgaccagcaaatgacgcnatagaaagcatcacagggcaggggcgagatgaacggcgcgccggtcacgctgccgcncggaa

SEQ ID NO: 433078 - DNA, 1501 bp, Homo sapiens
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaaaaaaaaaggaaacaaaagaaaaaaaaaaaaatttgtgggggcgcccgggcacgaaaaagtcttcaaaaacccacttccggtgggcgcggggcccaggtgtgtatgtgaccttgggcataacggggtccaaagagaacaccgggccagagacatgtgtggtttctccccaaaaaaaacccggggcaccgggtgttgacaacccaggggggtcgggctacggtacacagggccgcg

SEQ ID NO: 433079 - DNA, 1141 bp, Homo sapiens
ggacgcgtgggtcgacccacgcgtcgggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaa

SEQ ID NO: 433080 - DNA, 1073 bp, Homo sapiens
  misc_feature (4)..(4): n is a, c, g, or t
  misc_feature (76)..(76): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (92)..(92): n is a, c, g, or t
  misc_feature (94)..(94): n is a, c, g, or t
  misc_feature (105)..(105): n is a, c, g, or t
  misc_feature (113)..(113): n is a, c, g, or t
gttnagttttcagcgctgaggctcacagacttatgcaaatcccgcaagatgcctgctgtggtgtccagctgaagtnacnctncnggagcctngncctgtgcttantctgagantctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaa

SEQ ID NO: 433081 - DNA, 764 bp, Homo sapiens
ttagctaataaaatattcagtacaaatatatgtttggatttatgcattaaaaaactaataaaattatttccaactttaaaaaaaaaaaaaaaaaagcattgcggccgcaatgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaatattttgtgtctgattttgtattaaggactcaaggatttctgtttgcctgtgagattgagtgctggaatgagagagtgaaattgttgtttttaagtctttgtagaattttgcaaatgtcctgaaaaatagataactgtataacatgaagaaaatatctctattaatggcaacatttgttctctgaaatagctatatataaactcataaataaac

SEQ ID NO: 433082 - DNA, 1900 bp, Homo sapiens
tggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaagtcctcctgcatatgcccaagaggattgggagtggaatggacaccagcagaagcaccacagttattcctgtagagattagaaacaaggagcttattgccctgcttgtcaaggctcaggacagacaggaggaagaaacaagtataaaggttttggttttggaaagaagttggaatctccagaccctgggaccttaagatccacaaaattgctgaaagaaaaagtactaccttattgaaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtgagtagtcaccctgctgtgatttaagtgtcatccacctgaccaagttaaaatcaggtgtattataatgagggatcacagaagtgtgctcacatttctgaaatcctagagttaaacaattagtaaagaccttttattgaaagtaggactctatttggtagtgagacggtgggtttttaacctgtaatttctctttttagaggatgaacttcaaatactttaatcaacaaattatgaaaacgttttaagaatgttaaactgcattggaatgatatgcatgtttgcaagggtgttacaacaacttttgggtaactgcactaaaatttggcccttcccaagttttcttccaatactgtaaacctagccacagagacttaaaaaaaaaaaaaaacaacagagtaagacgtggaaattttgttgagatgacttcatttcaaaataattgagcacaagatattctgcgtaataactgacatctatagaaagttacttttgttttacttttaaattaaatcgaattactgtaatgcctctaaactttcaggcattttaataaatgctttatgctacagttgtcacctacaaaaattacttcgaggtgatccgctacctagccatcatgttaaagggattagcagtctcattatcataatgacactgttttagattcaggata

SEQ ID NO: 433083 - DNA, 766 bp, Homo sapiens
ctaaattgacgttcatggaaattgtaaccttttctctttgtagttcaagtattagaactttcagcagaaagagacttttggaggtcacaaaaagttgatatttaccaagttggatgatcgttttcagaatatccttgactgccgggtggcttggctgtgagcagggtgccatgttgctgtccctttgtttcaggtctctcaggcagctgcagagcttcaacagtactgtatgcagaatgcctgcaaggatgccctgctggtgggtgttccagctggaagtaaccccttccgggagcctagatcctgtgctttactctgaagactcgtgagtaatgatacaccatgatgtcttgggcccatagcattatcacagggcttcccaaaggacttgagcaactgagttttgaatgtctcctattcttggggaaattaaaacaagagccagcaaaatgcacaactttccctgaagtgtgattctagtgtatatttaccttgcctgtagaatacatctaatcaggacagtctgaagtctctctggcactaagtcatgagatgccaacatccttctgtacttgagctctttgagttggctggtagtaatttcttcctttctttctttcttttttttgagacagtctcgctctgtcacccaggctggagtacagtggcatgatcttggctcactgcaacctccatctcccaggttcaagcaattctcttgtctcagcctcccgagtagctgggactacaggtgcctgccaccacg

SEQ ID NO: 433084 - DNA, 2486 bp, Homo sapiens
tggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaagtcctcctgcatatgcccaagaggattgggagtggaatggacaccagcagaagcaccacagttattcctgtagagattagaaacaaggagcttattgccctgcttgtcaaggctcaggacagacaggaggaagaaacaagtataaaggttttggttttggaaagaagttggaatctccagaccctgggaccttaagatccacaaaattgctgaaagaaaaagtactaccttattgaaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaaaaaaaaaata

SEQ ID NO: 433085 - DNA, 1481 bp, Homo sapiens
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcatttttctatgacagcaatattttgtgtctgattttgtattaaggactcaaggatttctgtttgcctgtgagattgagtgctggaatgagagagtgaaattgttgtttttaagtctttgtagaattttgcaaatgtcctgaaaaatagataactgtataacatgaagaaaatatctctattaatggcaacatttgttctctgaaatagctatatataaactcataaataaac

SEQ ID NO: 433086 - DNA, 1405 bp, Homo sapiens
gcacccgcgctcggggctggcggctcctccccgcccggccgggcccagcagcccctaggagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttctgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaaaaaaaaaaaagacaaaaagaaaacattttgtgggccggccttaggcctgagaaaagtttttacagaccctttgttggggggacgggccccagaggttacgcgaccggggccaaagcgggaccaaaaagaaccgggcaagaaaagcggggtttctcaca

SEQ ID NO: 433087 - DNA, 2266 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaaaaaaagaaagataaagagaaacaaaagaagcagaaaaggaaaaaagaaaaagcaaaaaagaagagagaaacgaacagaaaaagaaagacaaggaggaagacgaaagaagcaagaaagcaacagagagacacagagagagcgcgacgaagaagaaaaaaaaaagaagagggcgcagagagagagagagtaagagaagagaggcgaagcaacacataaagaaggggcaaacag

SEQ ID NO: 433088 - DNA, 2626 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaaaaaaaaaaaaaaaagagaaaaaaaaaaaagaaaagaacaaaaaaaaaaaaggaaaaacaagaaagaaaaaaagaaacaatagactaaaaaaagcttatgaaagatcaaaacaaaaaaaagcagcttagccaaatatgccaagaaaaagaccacaactgaaaaacattcagcggccgacctgctccgctaaaactacagaaggccatgaaggcagtgcatcaggttcacctgcagtacatttctttgaagctcagcatctttcacgtgcaagatttgaggggacaggacgagattatagcatttgaggatatctgaaatgagccgtcacacagcgaagtcatgggagagccacacttgatggtggaatattgaccaggcagactgtaatcagcgcactgtgccgtaaaccgaaggttgcatatcgatagtggcatctacggccagagcttgatggcagaacattttgggacaggagcctgaacgaacgtcgtttccaccgtgaacgggctggtcggcccgcttatctcgggaccgacccacaaccggagccgattatgcaatgcgggccccaatgggggctagcggccctcc

SEQ ID NO: 433089 - DNA, 1981 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433090 - DNA, 2102 bp, Homo sapiens
ccaccacgcctggctaattttttgtatttttagtagaggcagggtttcatcatgtcagccaggatggtctcaatctcctgacctcgtgatctgcccgcctcggcctcccaaaatgctgggattataggtgtgagccaccgcgcccgcccaacaagcagttcttataagcataagcattgcttttgaccactgttaagtctgggcagcagcatgtttgtgctaagcctcattttatctcctctggcgcacatccggatatttcctagcaaacacacaggtaacaaaaggtcatggattacagacttgcccagtcttgatacctagagatggattccctggttggtggcagcagaaagggggaaagttcacctcccagctgtggtcactatcactgggcaatggctaatcactgctcttctgccctgatgttcaggaccccttctgttctcaactatttttgtcttttaagccttcagatactcttaaatgagataacaacagcagccacggcagtggcctgcttcttgctacatcctagtagcgtttatcagtgtgtcagaatcatacttggagaggagggttattgctaaaatgaggattcctaggccccaccctcaacctattgaaaccgaaactcaggagtctgcattttaacaaacccaagtggttatttagtatattctagtggttgaaatgaactgaaaatcttaatttagatcagaaattttatctagtccttccctagaatgaattaatttttaagatttgttaacccagtttaacaaaataattcttctctgttcccctttctaggtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433091 - DNA, 1850 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433092 - DNA, 1348 bp, Homo sapiens
ggagctcggcccctatttttatttctttttgcgaagactattataatgtcacagattcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433093 - DNA, 1109 bp, Homo sapiens
ttagaagagagagttcaagagggcgtgaaaccgttaagaggtaaacgggagcgggcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433094 - DNA, 1529 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcactggaagacatcttgtggagaccatctagttcagcttcttcattgtatagctgaggacacccaggcccagagaggggaagtgatttggtcaaagtcacacagcaagtaaaggacaaagctgagagcagatcccaggcaagcttcttccatctggtgaaaaagatgaacaccaggcgtgtctgatcttcccagaggaagaagggagcatctttttgaacagcatttctgtgagaaatgggatcctaaggtggcctccaagattgacacgccatggtacaatcttcgtgatcgtaagaagaacctgtgaatacgatgagctatcactcctgtgcttttgcggttttatgtggcaaagggagagtgttctgggtgggcctgacctgatcaggcatatcctctaaaatcagagttttctccagctggttccagaagactaagtcagagagatgctctgtgtttgggccagaagcaagcaaacatccacattgtgaactgcctatgggggccacctggcaaggaactgcaggtgttttctgggacctgagagcattccctggccaatcattagcaggaaaacaggaactcactcctataactgagaggaaataaaatttaccaacaaccaatgagcctggaagaagaccctgagcctcaaatgagaactgcagccccagccaacactgatttcagccttgtaagtacctgagcagagaactcagccatgctatatcaggacttctgacctacattactgtaagatcataaatgtgttgttttaagcca

SEQ ID NO: 433095 - DNA, 831 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcaaagtacttacacatctttcacctaagattgccgcccttacagccatcctcagccttctaaggcaaggggggtttaaccgtttcat

SEQ ID NO: 433096 - DNA, 2035 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433097 - DNA, 1980 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaa

SEQ ID NO: 433098 - DNA, 1903 bp, Homo sapiens
  misc_feature (1567)..(1567): n is a, c, g, or t
  misc_feature (1571)..(1571): n is a, c, g, or t
  misc_feature (1575)..(1575): n is a, c, g, or t
  misc_feature (1579)..(1579): n is a, c, g, or t
  misc_feature (1582)..(1582): n is a, c, g, or t
  misc_feature (1599)..(1601): n is a, c, g, or t
  misc_feature (1608)..(1608): n is a, c, g, or t
  misc_feature (1613)..(1614): n is a, c, g, or t
  misc_feature (1617)..(1617): n is a, c, g, or t
  misc_feature (1619)..(1619): n is a, c, g, or t
  misc_feature (1634)..(1640): n is a, c, g, or t
  misc_feature (1644)..(1644): n is a, c, g, or t
  misc_feature (1646)..(1647): n is a, c, g, or t
  misc_feature (1649)..(1649): n is a, c, g, or t
  misc_feature (1651)..(1653): n is a, c, g, or t
  misc_feature (1655)..(1656): n is a, c, g, or t
  misc_feature (1659)..(1659): n is a, c, g, or t
  misc_feature (1663)..(1664): n is a, c, g, or t
  misc_feature (1670)..(1671): n is a, c, g, or t
  misc_feature (1674)..(1676): n is a, c, g, or t
  misc_feature (1683)..(1685): n is a, c, g, or t
  misc_feature (1687)..(1687): n is a, c, g, or t
  misc_feature (1692)..(1693): n is a, c, g, or t
  misc_feature (1695)..(1695): n is a, c, g, or t
  misc_feature (1700)..(1700): n is a, c, g, or t
  misc_feature (1702)..(1702): n is a, c, g, or t
  misc_feature (1706)..(1706): n is a, c, g, or t
  misc_feature (1711)..(1714): n is a, c, g, or t
  misc_feature (1716)..(1716): n is a, c, g, or t
  misc_feature (1718)..(1719): n is a, c, g, or t
  misc_feature (1723)..(1723): n is a, c, g, or t
  misc_feature (1727)..(1729): n is a, c, g, or t
  misc_feature (1731)..(1731): n is a, c, g, or t
  misc_feature (1733)..(1733): n is a, c, g, or t
  misc_feature (1737)..(1738): n is a, c, g, or t
  misc_feature (1763)..(1763): n is a, c, g, or t
  misc_feature (1775)..(1775): n is a, c, g, or t
  misc_feature (1778)..(1778): n is a, c, g, or t
  misc_feature (1780)..(1782): n is a, c, g, or t
  misc_feature (1785)..(1786): n is a, c, g, or t
  misc_feature (1788)..(1788): n is a, c, g, or t
  misc_feature (1791)..(1791): n is a, c, g, or t
  misc_feature (1794)..(1798): n is a, c, g, or t
  misc_feature (1800)..(1800): n is a, c, g, or t
  misc_feature (1802)..(1802): n is a, c, g, or t
  misc_feature (1804)..(1804): n is a, c, g, or t
  misc_feature (1807)..(1807): n is a, c, g, or t
  misc_feature (1811)..(1811): n is a, c, g, or t
  misc_feature (1833)..(1833): n is a, c, g, or t
  misc_feature (1856)..(1856): n is a, c, g, or t
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcatgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgagacagtattatcaaaacacatgtgcacacagattattttttggctccaaaactggattgcaaaagaaagaggagaagaatattttgtgtgttcctggtattcttttataagtaaagtttntgtngggntggnagnggttgagtgagggatannntcgggtngcccnngcntntggcccggtcttttnnnnnnngttntnntntnnngnnttnggtnngggttnntgnnntgggggnnntntgttnntnggttntngtgntgttnnnntntnngtgnggtnnntngngggnngcgcccctggtcttccccgcctccnctgttgcgccgngcngnnngtnntnttnttnnnnntntncntgntttncgccgctgctctccgcttggtnttcccgcggccctgtgcggcctnccggtcctgccttcttcccgcgccccgttgcctctgcgttcttgtgt

SEQ ID NO: 433099 - DNA, 1324 bp, Homo sapiens
cgcggagggggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcacatctttttgaacagcatttctgtgagaaatgggatcctaaggtggcctccaagattgacacgccatggtacaatcttcgtgatcgtaagaagaacctgtgaatacgatgagctatcactcctgtgcttttgcggttttatgtggcaaagggagagtgttctgggtgggcctgacctgatcaggcatatcctctaaaatcagagttttctccagctggttccagaagactaagtcagagagatgctctgtgtttgggccagaagcaagcaaacatccacattgtgaactgcctatgggggccacctggcaaggaactgcaggtgttttctgggacctgagagcattccctggccaatcattagcaggaaaacaggaactcactcctataactgagaggaaataaaatttaccaacaaccaatgagcctggaagaagaccctgagcctcaaatgagaactgcagccccagccaacactgatttcagccttgtaagtacctgagcagagaactcagccatgctatatcaggacttctgacctacattactgtaagatcataaatgtgttgttttaagcca

SEQ ID NO: 433100 - DNA, 717 bp, Homo sapiens
cgtgcccccagagcacaagtactcagtgtggatatgctgttccattcctggcctcatgtccaccttcaagccagatgtgattagcaagcagaagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaa

SEQ ID NO: 433101 - DNA, 618 bp, Homo sapiens
gattgcgagctcgtaccccacacaccttgtccttgaagcttgtatctgatatcagcactggattgtagaacttgttgctgattttgaccttgtattgaagttaactgttccccttggtattacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaa

SEQ ID NO: 433102 - DNA, 641 bp, Homo sapiens
  misc_feature (22)..(22): n is a, c, g, or t
  misc_feature (46)..(46): n is a, c, g, or t
catgagccggtccaggctactncacaaacaggaatagccttcgaanagattgtccttgaagcttgtatctgatatcagcactggattgtagaacttgttgctgattttgaccttgtattgaagttaactgttccccttggtattacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaa

SEQ ID NO: 433103 - DNA, 506 bp, Homo sapiens
  misc_feature (22)..(22): n is a, c, g, or t
  misc_feature (46)..(46): n is a, c, g, or t
catgagccggtccaggctactncacaaacaggaatagccttcgaanagattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaa

SEQ ID NO: 433104 - DNA, 2788 bp, Homo sapiens
ggggaatctagatctagtaagacttcttcaaaatcctgatttccaaggccgatccagctgcttattcccaagtgctgacccacagccttcttttattccaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatggtaagtaagctgggatcaagacaaaattcatcgaagtgggaggagggagaacccagtccaggacaacctatgagttgtgtgcatgtggcagaaagcaagtgtgaaggcaagtctaagtgaatctttttcccctttctccctacagtccctatattataggtaccaccaatcagcctgtaaaaatgacacccaaccatggcttgcacttgagcttcaggtaagacctctagctctggatgaaccttctgaccctacccaagagtcttcaatcctggactctggccaggaggcagtagataggagaaggaaagagaagtatccagagctttttgggctggaaatagaaagtagatgtatttgtcatgtcagttacaaggtggaggaggacacttgaggagagaaaaggcctgctaagctaagagagagccaggtaggttgctctaagcagaattaggattctctgcccgcacacgctgatctgggtcagtgatgtcagaaggttatccgaagagggctaccaatttgagaatcagctctaccaccccagggctgctgctctgagttccgatgtccccactattacttgaaaagaaaccaagtaggcattagtgagaagcaggcagaaggagggacagactggcaggggctgaaccctgacaatgtccccattgccactctgaccccactttccccatccttggtggcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggtactggggtccagcttcccccgggggtcaggaggtggcttcccttttccactgtaccacctggagggatgctcccttctcttcctggagtcttcggcatgtaaaggagctgcaagccttgtggcttcagacttagaaccacttaacgagccttcccaacacagttagcaccacttcaatcaccagaaagctaacccctctccttgtttttttcccacaattaacagaaaaaaggaggcacatatgtaggaaggaattaaacagctttcctcactcccttatctcacttctaccttgtgaagcaggacttatgagattgccatctaggcagtcagcacccactagtcttgacaactctaaatttcctttaatcctttgactgtcagacccctctgcctggtactaaggagtaaaagaggcacacaaccgggaagatctaggttcccagccatcttcatggccccatcctcttccctaggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctactttttta

SEQ ID NO: 433105 - DNA, 586 bp, Homo sapiens
ccggttctgtgaagcagtacgccatgattggcctactaggaatccattcaggaatagtgcctgggataggcctgttatctacttgctgcatctctttaaatccatctcttctttcagctgagtaaaagaaatcagttaataaaagacaaggacctgtaacacacccatgcagtgactgtggggaatttgaggaaagactaggaattgggatcacttggcctagggaaaagaaccattgttcagacaggatcatctgccctctgaagggctactaaatggaggatggggccagcttgttctctatctccattgaagaccaaataagaagaattgcatttatgctgcagaatgaggggctgggctaagcaataattacctcaggaatttgaaaaggtcaacagagaggtgtgctatcttcttctgcacaggtctttatggacagattagacatccacctgcctgtatggaggcagaagaatagacaagggagctccttgtgggtatgaaaccctgaaaggctgtaatcccagcaatgggcaaaggggtaaggcatctgcaggttaacgggattcagctgaacccagct

SEQ ID NO: 433106 - DNA, 586 bp, Homo sapiens
gtgattgaggagttggttggttctcctttctcttatcttctgccactagacttgcctgaagtctcacatcctctctaaatctgttctatgtttttcccacttgtacttggccctagaacttcggatcaagagacaaaactcctcagatagcatctcaagcctcaacagcatcactagccattccagcatcggcagcagcaaggatgctgatgcgaaaaagaagaaaaaaaagagttgggtaggtaaaggtttggggggtggggaagtaggtagaaccgtggtggaccgccttcacctcagcatagggatcgaatccttccaggattaaccaaggtgtagtcccgtctaacactgagccctagtgtgatgtccgctcagagcatggtctcccagattctcccttccctcaatcatttcctacttgtccccaaggccacccctctgacctttatatgcatctgctttctttgggctctccatactggttaggccaagatgtatttggcaacagaaggatgctgaggatatactcagaaggaaacatcttatcagttctgtccccaccaccccccattcccttctatac

SEQ ID NO: 433107 - DNA, 860 bp, Homo sapiens
ccggttctgtgaagcagtacgccatgattggcctactaggaatccattcaggaatagtgcctgggataggcctgttatctacttgctgcatctctttaaatccatctcttctttcagctgagtaaaagaaatcagttaataaaagacaaggacctgtaacacacccatgcagtgactgtggggaatttgaggaaagactaggaattgggatcacttggcctagggaaaagaaccattgttcagacaggatcatctgccctctgaagggctactaaatggaggatggggccagcttgttctctatctccattgaagaccaaataagaagaattgcatttatgctgcagaatgaggggctgggctaagcaataattacctcaggaatttgaaaaggtcaacagagaggtgtgctatcttcttctgcacaggtctttatggacagattagacatccacctgcctgtatggaggcagaagaatagacaagggagctccttgtgggtatgaaaccctgaaaggctgtaatcccagcaatgggcaaagggtgagtcccactgcggccaccacgccaagaatcacccgctccaacagcagcaggaggagacctcctcctgctgctgtcctcctcctctcccaaactggcttcggcttgacttgtgacttgctttggccaacaggactttagcaaatgtggcacagtggatgcttgtggtttgtttggggtttgctctctggctgccctgaggcggcaggtgaagaagcccaggtcagctcaccggccagaaatcgggatcctctaactcttgctgctcctcagtgggaaagagagacaaagtatgtgagtcaatcctatcacaagac

SEQ ID NO: 433108 - DNA, 5183 bp, Homo sapiens
tggggtctgtagtgggcccgttatcgtgcatgtaccaggcgggcgtcccctccgagcggcagttcccacccacagttggcgcgtcagcagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggt

SEQ ID NO: 433109 - DNA, 4988 bp, Homo sapiens
tggggtctgtagtgggcccgttatcgtgcatgtaccaggcgggcgtcccctccgagcggcagttcccacccacagttggcgcgtcagcagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggt

SEQ ID NO: 433110 - DNA, 5195 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctactttttta

SEQ ID NO: 433111 - DNA, 5891 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttaaaaaaaaaaaaaaaaaaaaaaaaaaaaaaaaaaaaaaaaaaaaaaaaaaaaaaaaaaaaaaaaaaaaaagagagagggggggcgggcggcgcgcgaggagaggccccccgcggagggagcgccacaaacctacggagcgcccaccaagaatgtttggtagagaaaagagaggggcgcccacaaaagaggagggcgagtgatatatataaacaacaaagagagggaggcggggcgagggcacaaaacaaaggacgcggccgcggcgaggcgaacagaagcgcggccacacggcggggaagcaccttgtgagagcaaagcgcaagcaacccacaagacagcgggggggagcgagagcagacaaacaagggggagccacaaaaaatcaccccacgagcaagaggtagcgttacggcagggaggaaaacgacagggggggcgcgcaacataaataaaaccaaaagcggagacagcgccgctatgtgatagcacgccgtggcgcgagaagaaacaaaaacacaaaaggaccaggccaaacatttaacacgcgaagtgcacgccaggagacgccagcacacaacaagacgatagcggagagaacaataggggcgggaataagagatgacaacaaaccagccaagcagagcattattttgctctccaccacagcacgaagcgcctagcagtaaccaacaacca

SEQ ID NO: 433112 - DNA, 7004 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatggtaagtaagctgggatcaagacaaaattcatcgaagtgggaggagggagaacccagtccaggacaacctatgagttgtgtgcatgtggcagaaagcaagtgtgaaggcaagtctaagtgaatctttttcccctttctccctacagtccctatattataggtaccaccaatcagcctgtaaaaatgacacccaaccatggcttgcacttgagcttcaggtaagacctctagctctggatgaaccttctgaccctacccaagagtcttcaatcctggactctggccaggaggcagtagataggagaaggaaagagaagtatccagagctttttgggctggaaatagaaagtagatgtatttgtcatgtcagttacaaggtggaggaggacacttgaggagagaaaaggcctgctaagctaagagagagccaggtaggttgctctaagcagaattaggattctctgcccgcacacgctgatctgggtcagtgatgtcagaaggttatccgaagagggctaccaatttgagaatcagctctaccaccccagggctgctgctctgagttccgatgtccccactattacttgaaaagaaaccaagtaggcattagtgagaagcaggcagaaggagggacagactggcaggggctgaaccctgacaatgtccccattgccactctgaccccactttccccatccttggtggcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggtactggggtccagcttcccccgggggtcaggaggtggcttcccttttccactgtaccacctggagggatgctcccttctcttcctggagtcttcggcatgtaaaggagctgcaagccttgtggcttcagacttagaaccacttaacgagccttcccaacacagttagcaccacttcaatcaccagaaagctaacccctctccttgtttttttcccacaattaacagaaaaaaggaggcacatatgtaggaaggaattaaacagctttcctcactcccttatctcacttctaccttgtgaagcaggacttatgagattgccatctaggcagtcagcacccactagtcttgacaactctaaatttcctttaatcctttgactgtcagacccctctgcctggtactaaggagtaaaagaggcacacaaccgggaagatctaggttcccagccatcttcatggccccatcctcttccctaggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttaaaaaaaaaaaaaaaaaaaaaaaaaaaaaaaaaaaaaaaaaaaaaaaaaaaaaaaaaaaaaaaaaaaaaagagagagggggggcgggcggcgcgcgaggagaggccccccgcggagggagcgccacaaacctacggagcgcccaccaagaatgtttggtagagaaaagagaggggcgcccacaaaagaggagggcgagtgatatatataaacaacaaagagagggaggcggggcgagggcacaaaacaaaggacgcggccgcggcgaggcgaacagaagcgcggccacacggcggggaagcaccttgtgagagcaaagcgcaagcaacccacaagacagcgggggggagcgagagcagacaaacaagggggagccacaaaaaatcaccccacgagcaagaggtagcgttacggcagggaggaaaacgacagggggggcgcgcaacataaataaaaccaaaagcggagacagcgccgctatgtgatagcacgccgtggcgcgagaagaaacaaaaacacaaaaggaccaggccaaacatttaacacgcgaagtgcacgccaggagacgccagcacacaacaagacgatagcggagagaacaataggggcgggaataagagatgacaacaaaccagccaagcagagcattattttgctctccaccacagcacgaagcgcctagcagtaaccaacaacca

SEQ ID NO: 433113 - DNA, 6519 bp, Homo sapiens
  misc_feature (2699)..(2699): n is a, c, g, or t
  misc_feature (3524)..(3524): n is a, c, g, or t
  misc_feature (3731)..(3731): n is a, c, g, or t
  misc_feature (3739)..(3739): n is a, c, g, or t
  misc_feature (3761)..(3761): n is a, c, g, or t
  misc_feature (3787)..(3787): n is a, c, g, or t
  misc_feature (3880)..(3880): n is a, c, g, or t
  misc_feature (4333)..(4334): n is a, c, g, or t
  misc_feature (4486)..(4486): n is a, c, g, or t
tggggtctgtagtgggcccgttatcgtgcatgtaccaggcgggcgtcccctccgagcggcagttcccacccacagttggcgcgtcagcagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaaggtaggacatccagccacagattgagagggaacagggagcaggaaagtaagagtattacagatttttatctgggcccatagtattccaagtcctatatcaagtctctagaaggtgagggcctttagataccctttagtgtgatgtctggactggtcagtgaggagtaccaggggcatgaccccagcttcctagggcatgaaggcaagnagaggagacctgtaagccccaggggtcctctccttaacctttacctcacggccaaagagccatcaaagaccatcgttaaaatagccctttacatttttatgcaaatgtgttgtgtgtccacacacacacaaacaatcttatttgatcctcactttagttctccaactactcttccaatgaaacaaccaaagctcacataggttatatggtgctgaaatggcaagttagcctggacgtttagtaaccagtcaagctttgctacagaagtcaagatggatgggagtctgatgccacaaaatctgtgatctctaactccagtcaggtcttcaagataccttggcagtcctcttacttgtccacagtcagttttcttttttattccactaccagtgattcccagctttcattgcttttttcaagctcctcattccaccactgatttgccttactctgaacatagctttggcgccccccttagttaagaaaatgaacattttcaagagagaactccattgacttttccccactccatgcgtttatattcatccaatacttatttatttgtctccattttgttggaaggattcatcccttctggccaagagtgaccgcttatctaatgttttgggatgccctctttagcaaccatacaacccccctttacccaacacatgcccttttctacctctctaatctcttatgctctattcattccttccctgcttataaacctgccaaaggctcttgtatgttaaaggggaaagatgtatcaatctatgttctaactataatcttatttctttgcttcctccagtcgatcctacntttccacctccctttcacacctaaccccactataattatgcttctgtcaccatcattctaccaaaaacactttcactgcagtcaccagtgactcccatttttccaaaatccaacttacaatttttagtacttattttccttttttttttttttttgagtcggagtctcactctgttgcccaggctggagtgcagtggcgtgatctcngcttaccncagcctccgcctcccaggttcnagcaattctcctgcctcagcctcctnagtagctgggactacaggcgcatgccaccatgcctggctaatttttgtatttttagtagagatggggtttcaccatgttagcaaagtgttttnaagactcatccatgttgtgtcatgtatccacacttcattcctttttgtggctgaataatattccattgtgtggatataccacagtttgtttagctgttcatcagttgataggtaggcattgagttgttttcactttttgcctattatgaataatgctgccataaacattcatgtacaagtttgtgtgtggacatatgttttttgttctctggggtatatacctagaagtggaattgctgggtcatatggtaactctatgtttgactttttgaggaattggcaagctgttttccagagcagctacaccattttacattcctgtcagcagcatatgagggtgcgatatctccacattctttgtttttgtttttttgagatggagtctcactctgttggccaggctggagtgcaatggtgcaatcttggctcactgcaacctccgcctcccaggtnnaagtaattctcctgcctcagcctcctgagaagctgggattacaggtgcccgccaccacacccagctaattatttgtttgcatttttagtagagacaggtttcaccatgttggccaggctagtctcgaactcctgacctgcagtgatccgccnacctcggcgtcccaaagtgctgggattacaggcgtgagccacacacccagccctatagctccacattcttgctaacacttactgacctcttttttgtaatagctagcttagtgggtgtgaggtggtatctcgttgtggttttgattttcatattcttaatggctaataccaagcatcttttcatgtgcttatttgctatttgtatgtctttatggagaaatgtgtattcaaatccttggcccacttttaaaatcaggttatttgtcttttgttgttgagctttaagagttttttaataattctgaatattagacccttatcagacacatgatttgaaaaatagtttctctcattgtatgggttgctgttttgctttcttgaaaatattctttgaagaacaaaagttttccattttcatgaggcatcatttatctagttttttcctttggctacttgtgctttaggtgctgtatctaagaaattattgcctaatccagggtcatgaagacttactcctggaattccttctaaatttttttttagttttaggtctttgttccatttttagtaaatttttgtacatggtatgaggtaggcagtctaacttcattcttttacatgagaatatccagttgttccagcatcatttgctgaaaagactattttttcccccactgaattgtcttggcactctaggaaatcaattgactatacatatatgagtttcattctagactttcagttctattccattcttctatatgagtttctttctagactttcagttctattccattcttctatatgtctatccttggccagtaccacattgttttgattactgtagctttgtagtaagtttggaaattgggaagtgtgagtcctccaactttgttctttttcaaggttgttttggctactctgtgtcctttgcatttccatgtgaatttcaggattcgtttgttaatctcagattgaattttgctagggattgcattgaatctgtatatcaatttagagagtattgcctcttaacaatgttaagtcttccaatccatgaacaggcatgcctttatctaaatattctttcatttctttcagtgatattttgcagtttttcagcatatgaaccttgtacttattttgttaaacttagtttttatactgttctaaactgaattgttttcttaatttctcttttgagttatagattactagtgtataaaaatacaattgattttttgcacattgatcttatatcctgcagacttgctgggctcacttatcagctcaattggttttacaatctcttcttaatctgtatttctatccatatcagtctcctgagttccagacctttacttccaaccacgtttggatgtttccacttagttgacctcatagagatatctctaacttaatatgtccaaaattaaagtcatccccttcaccccacttacaacaaacacacaagccaaccttttcccttctgcagtttgcgtatctcaggtattatcatttgcctggttgcccaagcctctaatatgagaatcatctttgattcctcactgtttcaccctgtatagtcagttagttctaactcctacgtagatctcaattctatccctcttctgtattgtcactaccctggctcaggtttttatcattcttctcctagaatatttcaataatttccttactggtcttgctgtgctcgttcttccagtgctttccttgcccccagagtaatccaattatatcagttaagatgagaaattactccaggccaggcacagcggcccacgctataatcccagcacttcagaaggccaagacgggaggttcactttaggccaggagttcaagacaagcctgggcaacatagtgagacctcattcttaaaaaattagcctgtagtcctagttactccagaggctgagtctggaggactgcttgggcccaggaggtagaagctgcagtgagccacagtggttgcactgactccagcctgggtgagagagagacctggtttc

SEQ ID NO: 433114 - DNA, 2404 bp, Homo sapiens
tttagaaatatagtccttggacacttggaaaacagcttcatccagcatcttccagtcaacttttccactgaccttgctacagcccgaggaagaattcctgccgctccctaggcggtgggactcagcccattcttcggccccagcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctactttttta

SEQ ID NO: 433115 - DNA, 4391 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcagggcccgagagtacaggccgagagta

SEQ ID NO: 433116 - DNA, 1917 bp, Homo sapiens
cattgaggacttccggacctggttcattgacctgtagatagggaatgatagagttgttccacaggtcaatgaaccaggtccggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttaaaaaaaaaaaaaaaaaaaaaaaaaaaaaaaaaaaaaaaaaaaaaaaaaaaaaaaaaaaaaaaaaaaaaagagagagggggggcgggcggcgcgcgaggagaggccccccgcggagggagcgccacaaacctacggagcgcccaccaagaatgtttggtagagaaaagagaggggcgcccacaaaagaggagggcgagtgatatatataaacaacaaagagagggaggcggggcgagggcacaaaacaaaggacgcggccgcggcgaggcgaacagaagcgcggccacacggcggggaagcaccttgtgagagcaaagcgcaagcaacccacaagacagcgggggggagcgagagcagacaaacaagggggagccacaaaaaatcaccccacgagcaagaggtagcgttacggcagggaggaaaacgacagggggggcgcgcaacataaataaaaccaaaagcggagacagcgccgctatgtgatagcacgccgtggcgcgagaagaaacaaaaacacaaaaggaccaggccaaacatttaacacgcgaagtgcacgccaggagacgccagcacacaacaagacgatagcggagagaacaataggggcgggaataagagatgacaacaaaccagccaagcagagcattattttgctctccaccacagcacgaagcgcctagcagtaaccaacaacca

SEQ ID NO: 433117 - DNA, 885 bp, Homo sapiens
tggggtctgtagtgggcccgttatcgtgcatgtaccaggcgggcgtcccctccgagcggcagttcccacccacagttggcgcgtcagcagcaagctcagccatatctcccgcctggagctggtcgaatccctggactcggatgaggtggacctcaagtccggctacatgagcgacagtgacctcatgggcaagaccatgacggaggatgatgacatcactaccgggtaagcgcaggggcttcttggatggcgggggaggatggtggaaagaccactgggatgcgacgccttaaaagtggagtggaacccaaaacgggttttggtttgctgtgctgctatgaaagtacacaaaagtgtgctgtgtacactttgtgattgcctctgaaattcgatgtggtttattctagacttgggtgtggtgtaggcagggcctacatccaaggagctgattggtcaatgaaggcgcctccctctcattggtctctgtggctgtcattctgtcaccctcctccctggctctttgccctcaataaactggctcaaagagccttggaaaagcattttattcccagctcttatgcgaactctgtgtagaccctggacaactaaatctgctttcccatttgcaaaaaaaaaaaaaaccaaaaaggttattaacatcgtatctgtctacctaagaagagaaaatgagagcttgtgggtgaaatcgctagtcaaacagtgagtagcagcagtagctccacttcctttgccaggggttcgtaacccctcagttccctatccgacccctgtggtcctcagtgtctgctccttgggtttcttcctgtgcaaaccttctaccaatcatgcaacttcctaatccctacccagcgtgtcaaatccttc

SEQ ID NO: 433118 - DNA, 225 bp, Homo sapiens
gccccccgagatgcctccttgccgtcgaggtgtcaataacatatcagtctccctcaaaggtcagtctttgtctcttggggtgaggtggtgtggcatgaaggcagggacaggatcatcaaataatccatcatgcattcattcaccaagaactcactgagaaggtataatatgaagatgcttaagtaatgtgagatataaaaagatgagtaagacccagtcctaact

SEQ ID NO: 433119 - DNA, 325 bp, Homo sapiens
ccaccacgcctggccagttttttattgttttatttttattttttggtagagtcagggtctctctttgttttcaaagctgattgcaaactcctggcttcaagctatccttccaccttggcctcccaaagtgttgggattttgttgttgttgtttcccttctgtgggcaggacccagagtcccaactctcataaatccatctttttgcccccctttagatggccatgctgctgaaacttcaagaagctgccaactacattgagtctccagatcgagaaaccatcctggaccccaaccttcaggcaacactttaagggttcggcaatc

SEQ ID NO: 433120 - DNA, 491 bp, Homo sapiens
ctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggacccagagtcccagagaaagaggacagtgcagaatgtcctggatctccggcagaacctggaagagaccatgtcctgcc

SEQ ID NO: 433121 - DNA, 4933 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggt

SEQ ID NO: 433122 - DNA, 5084 bp, Homo sapiens
cgggtgtcaggcgagagcggtcctggggggcgctgggtgcccacccggtgaatggccgcctgagccggggaagatgcttcatctgcccctgcccagatccggaagaacggtgaatttcccccgcagctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggt

SEQ ID NO: 433123 - DNA, 3733 bp, Homo sapiens
ccggttctgtgaagcagtacgccatgattggcctactaggaatccattcaggaatagtgcctgggataggcctgttatctacttgctgcatctctttaaatccatctcttctttcagctgagtaaaagaaatcagttaataaaagacaaggacctgtaacacacccatgcagtgactgtggggaatttgaggaaagactaggaattgggatcacttggcctagggaaaagaaccattgttcagacaggatcatctgccctctgaagggctactaaatggaggatggggccagcttgttctctatctccattgaagaccaaataagaagaattgcatttatgctgcagaatgaggggctgggctaagcaataattacctcaggaatttgaaaaggtcaacagagaggtgtgctatcttcttctgcacaggtctttatggacagattagacatccacctgcctgtatggaggcagaagaatagacaagggagctccttgtgggtatgaaaccctgaaaggctgtaatcccagcaatgggcaaagggtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggt

SEQ ID NO: 433124 - DNA, 6369 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggtactggggtccagcttcccccgggggtcaggaggtggcttcccttttccactgtaccacctggagggatgctcccttctcttcctggagtcttcggcatgtaaaggagctgcaagccttgtggcttcagacttagaaccacttaacgagccttcccaacacagttagcaccacttcaatcaccagaaagctaacccctctccttgtttttttcccacaattaacagaaaaaaggaggcacatatgtaggaaggaattaaacagctttcctcactcccttatctcacttctaccttgtgaagcaggacttatgagattgccatctaggcagtcagcacccactagtcttgacaactctaaatttcctttaatcctttgactgtcagacccctctgcctggtactaaggagtaaaagaggcacacaaccgggaagatctaggttcccagccatcttcatggccccatcctcttccctaggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttaaaaaaaaaaaaaaaaaaaaaaaaaaaaaaaaaaaaaaaaaaaaaaaaaaaaaaaaaaaaaaaaaaaaaagagagagggggggcgggcggcgcgcgaggagaggccccccgcggagggagcgccacaaacctacggagcgcccaccaagaatgtttggtagagaaaagagaggggcgcccacaaaagaggagggcgagtgatatatataaacaacaaagagagggaggcggggcgagggcacaaaacaaaggacgcggccgcggcgaggcgaacagaagcgcggccacacggcggggaagcaccttgtgagagcaaagcgcaagcaacccacaagacagcgggggggagcgagagcagacaaacaagggggagccacaaaaaatcaccccacgagcaagaggtagcgttacggcagggaggaaaacgacagggggggcgcgcaacataaataaaaccaaaagcggagacagcgccgctatgtgatagcacgccgtggcgcgagaagaaacaaaaacacaaaaggaccaggccaaacatttaacacgcgaagtgcacgccaggagacgccagcacacaacaagacgatagcggagagaacaataggggcgggaataagagatgacaacaaaccagccaagcagagcattattttgctctccaccacagcacgaagcgcctagcagtaaccaacaacca

SEQ ID NO: 433125 - DNA, 5854 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgattcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttaaaaaaaaaaaaaaaaaaaaaaaaaaaaaaaaaaaaaaaaaaaaaaaaaaaaaaaaaaaaaaaaaaaaaagagagagggggggcgggcggcgcgcgaggagaggccccccgcggagggagcgccacaaacctacggagcgcccaccaagaatgtttggtagagaaaagagaggggcgcccacaaaagaggagggcgagtgatatatataaacaacaaagagagggaggcggggcgagggcacaaaacaaaggacgcggccgcggcgaggcgaacagaagcgcggccacacggcggggaagcaccttgtgagagcaaagcgcaagcaacccacaagacagcgggggggagcgagagcagacaaacaagggggagccacaaaaaatcaccccacgagcaagaggtagcgttacggcagggaggaaaacgacagggggggcgcgcaacataaataaaaccaaaagcggagacagcgccgctatgtgatagcacgccgtggcgcgagaagaaacaaaaacacaaaaggaccaggccaaacatttaacacgcgaagtgcacgccaggagacgccagcacacaacaagacgatagcggagagaacaataggggcgggaataagagatgacaacaaaccagccaagcagagcattattttgctctccaccacagcacgaagcgcctagcagtaaccaacaacca

SEQ ID NO: 433126 - DNA, 4971 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggtactggggtccagcttcccccgggggtcaggaggtggcttcccttttccactgtaccacctggagggatgctcccttctcttcctggagtcttcggcatgtaaaggagctgcaagccttgtggcttcagacttagaaccacttaacgagccttcccaacacagttagcaccacttcaatcaccagaaagctaacccctctccttgtttttttcccacaattaacagaaaaaaggaggcacatatgtaggaaggaattaaacagctttcctcactcccttatctcacttctaccttgtgaagcaggacttatgagattgccatctaggcagtcagcacccactagtcttgacaactctaaatttcctttaatcctttgactgtcagacccctctgcctggtactaaggagtaaaagaggcacacaaccgggaagatctaggttcccagccatcttcatggccccatcctcttccctaggcccttgcttctttctgtcgtgtcccattggcattgaggacttccggacctggttcattgacctgtggaacaactctatcattccctatctacaggaaggagccaaggatgggataaaggtgagccctacccccttcactcaaaccctaagatcaggctgtcctacctaacaaagtaggaatgtttctttaatgttaggcatgggactactaggattagttaggttctctttctaacaggtggagcaaggcactgggtagactaagctgctttcctgcctccagctgccattcagcaaatggtacaatgaccactgcctctggggccatctctccagtcctaggccttctggctctaagcccaatttaaaccactctctaggggtcagagcaaacagaaaaataattgagctaagaagtaagtaaaaccctaattaaaacaaacaaacaaacaaacaaaaccttagctacttactactaataagtatgttatattaaccaagttacttgacctttttaaataccctcatatg

SEQ ID NO: 433127 - DNA, 2736 bp, Homo sapiens
gttccaagttgcatgtgcttgaaatagatttaattcttattccccacagtttaggtatttttcattagtacatcaatttgacacactgaatgcaagactattaatcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttgggtaggtaaaggtttggggggtggggaagtaggtagaaccgtggtggaccgccttcacctcagcatagggatcgaatccttccaggattaaccaaggtgtagtcccgtctaacactgagccctagtgtgatgtccgctcagagcatggtctcccagattctcccttccctcaatcatttcctacttgtccccaaggccacccctctgacctttatatgcatctgctttctttgggctctccatactggttaggccaagatgtatttggcaacagaaggatgctgaggatatactcagaaggaaacatcttatcagttctgtccccaccaccccccattcccttctatac

SEQ ID NO: 433128 - DNA, 1560 bp, Homo sapiens
tggggtctgtagtgggcccgttatcgtgcatgtaccaggcgggcgtcccctccgagcggcagttcccacccacagttggcgcgtcagcagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtcccgactaacttggtccgagctcgatcga

SEQ ID NO: 433129 - DNA, 5126 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggtgttttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagt

SEQ ID NO: 433130 - DNA, 860 bp, Homo sapiens
gttgtccaaatataatcttgtgcactatcaagtatcaagaatggtatgtcaaataaaagaaacttgactttttctcagaagtatgtcctccttgtgccagttgcaatgattctgagtataagtagtacacagttgtaaaaaataaacctccaagactagtcatttttacattctgctaatggaattttccctcaggttatgttaaattgttgttctttttcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggtagttctgttgcactgacttgttcattaaccatttgtatttaatctgaacaatattaagcacctttcccaagaatatgagactatttgagatgcatgattctgctttattaaaaataacctggaaccatttaaaacatttgggagacttttaagagaaaagtgatcttgaaggtgttaaaataaagttttaatttatattatgattgaaatgaaaacgatggatacaattaagattatttacaaatacataattaaacatgttcacaaatgtgtgataacagaggatcattatagtacacatgcttttgatattcctgtgtttgctggcagggagtacttttccttaattacccagaaatggtttttgaaagatgttatctttgttattgttgcttttgtcttttattctt

SEQ ID NO: 433131 - DNA, 3969 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggcta

SEQ ID NO: 433132 - DNA, 2154 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggcta

SEQ ID NO: 433133 - DNA, 2622 bp, Homo sapiens
cccgcgcgcggtatatgcaatgcagtccgtctacgtgattcttcgtcatggttttcaaacacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggtgttttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagt

SEQ ID NO: 433134 - DNA, 2418 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggaactagcgtcaatatcgtcaccggagaagtgcaacaggtttacttgaggccaattccaatgcatactgaagaacatctaccacggggaatcgtttgggaccggaaccatagcctctaaatatctttctagcctt

SEQ ID NO: 433135 - DNA, 1831 bp, Homo sapiens
aaccgatgtgatgcatgtatacaagatgagagatcgatggtgttcctatctgggtcagtaaatggggaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggtgttttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagt

SEQ ID NO: 433136 - DNA, 715 bp, Homo sapiens
gagttttctgtattaatcacttgagtgcccctgcatctgcagaaatttctggcacgtggtgttgactctgtaggaagtttttgaagggaaaagtgaattgattacctttatatttctgtatcaaggaatacaatagtatatattcagttgccattaatggagatgagtttttcaaaaattaatatggattctgaatttctttatttttaaaactattttgagtgcttatacaattttataatttggggaagttaatctctagagaagaaaaaatggcccctgtgttgatgatcggcataagccaaacatgactgaaaaacacaataatgttttctccaccgctgttgcttttgtttctgttgttgccatatgcatagctttttctaaagagagattttcagttctagataggttgagattgttttctctaaataccgtttgttctaatactgtttgtgaacatatttatgttgtcttccttattaatacttacagatccttaatttaaaaaggaaacaaaaacctattcttttttttttcctgcattgcattaagaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaa

SEQ ID NO: 433137 - DNA, 432 bp, Homo sapiens
aatcattaaatgacaccttatatccttagatttgcaggaaagcatatccagaatccatcgaacaattgaattaatgtactctgacaaatctatgatacaagtaagtgaaattttgagctagtaatcattgtcaaaattatttacatatattttaatttacctttacattatcttaatctaatttttctttacatgttttgttttaaaattttggcaaatcttattgtaaaataataagggcttgcaatatgtacaatgtgacagttcatctgaatggggaaacttttataacaaatttataacaaaattcatgacaagttttccccattcagttgtattttcacaccgtatgtgttgtgtacccttactattttacagtaaaatctaccaaagtttttcaaaaggctatagcatctttaaaaagtcttatgg

SEQ ID NO: 433138 - DNA, 378 bp, Homo sapiens
ggttctccacagcatgattcattctttctaaaagaatgaagttgtttggcctttctcaagttctttttccttttttactctagtttactttattctgttttttgtttgttttggaaaaccaaaggtgatttgttttcttttcctagtatattttcagagttgagaatataatgattttgggtttttcctccctctagcaccagcagacgtttttgaatcaactgagagaaattacggggattaatgacacccagatactacagcaagccttgaaggtatggcctctgttttatgatatacagtttgtggtatatgctcatctctagtgcgtattatatttgatagttgattttttttttggggtataccatgtggtag

SEQ ID NO: 433139 - DNA, 5222 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcgatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggtgttttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagt

SEQ ID NO: 433140 - DNA, 3820 bp, Homo sapiens
  misc_feature (120)..(120): n is a, c, g, or t
aagcagcccgcggaccggcagcaaaggaacgtgcgaacgcgtgacgccgcccgactggctcgcgctctcccgtgccccggcgtcctccgcccgctcatggcccgggccgccgcggacgancggcgctgaggcgggccgcgtggagacgtgaggcggccgccgtggccctcacagtcggcgtttcgccgcctgcccgcggtgcccgcgcacgccggccgccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggcta

SEQ ID NO: 433141 - DNA, 2454 bp, Homo sapiens
ctcaacctgtagcctgtgacaatcattatcgaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggtgttttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagt

SEQ ID NO: 433142 - DNA, 3517 bp, Homo sapiens
ggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggatgttttcgtgtttgtattcgtatatgccagttcatttcctttgaaaaaaaaaaaaagtggaacacaaagtaggaagtgagaaccttctggctttggatggattgacttcttgattctttctggttttgcctgaacaccaagtagcttcataatcaaagggtcattttctggtttgtatcagaccgtatttataaagttgggtatttaatttcagtaactcctgtattttaacagaaaaagaacctgagtccatttgcagttaggctcgcaccagctgtcttctgtgccagccagctccgcccgagaccccggcacgtgttcgcagcacagcctggcaggggccctgagcggagttctcagcccgtctgtgccaaagttgcctgtgggtcacggaaacccggcccatgtccacccagtgcgtcaggccagccggggcccaaacctgtggatggaacgcaggtgcctgcacatctggggcctcagccagacctgtctccttcccaggcactgtcggaaaggggctggctcctgtctggtcagtggaggatggtggcaggagacggggtggggaggtccaggtcacgtcctctctggcgaccctggcagtggctgtctccaagccctggcaggtggggccaccaatctggccgacctcaggctctgggaaacaggctgccctcgtccctctgcctgtgggtggctgaggcttctcagcccatctccagttctctgcagcaaaggccctctgtttctgtcctgcagtggtggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgtgtaggcacagggttgccccagcactgtctatagcaaccccagtgtcctcacagtgcacgtgagccgtgacgcagccaccgtggagtcggcgctgacgcggtgtggccacgtgccatgagctcgccaacgcagtgcggctatatggcgtgagcttactgtgaagtggagacaggcagggacacaggaaactacaaacgagaaatccagaaggaggagctggaactgatgggcatagccggccgcgagcccctccgagcacccctgggggtggagttctggctgtcatggcagagggtttcacatgctcaaaaagtaaatgaaccaggatgtgaggggaacacaacagaccatgccgacggagctcccgggcccaggccggggcctcttcccatcgcactctgacccgccgtcgggagtgcccaggcccgggtcgggcctgcctctccgctcgcaccgcactctgacccatcaggagtgtggggaagaccgtcgaccaaaggtgggaaagacaggaaagatactgtactctaagtagtaaatttgttttttgcgtggacgattctgaagctgtattctgagatggaaaaaactagaaatacatcgtggatgatgagagccaggtgtattgagctcctgcttttctaacgtacaaaggtaactggatagagaaacggagtgatcgccctcacctggccagggtgtgctccgagaccccagcaggtgccgaagccgcggatagtcccgaatcctgtccaggcgctgttttttcctgtacgtacctgtgatcaagtctgagatgtgacagcaaaactgacagaacttcgtgcttccctcttcaaaatgtcacagatgggcactgtgttcttaccggagatcttagcaacctcggcatctggctgtttttcttataggtcaggagtttccaccttttcccttaaaggaagcgcttggcagcttctctggtgtgtctgagtcgccagcatcaccactgtcctgttctggggccattcttaagtaaaataaaagcttcttggacccaagcaccacatcaccgcgatggctggtctgatcaccgagatggctgctgagtgcctggcaggcagggtggcgtggatggcccgaaacgctggacggagggagggttgatgtcccagcaggacggctgctcagaacagcacagaatcaaaaactcatgaatggtttatttctggaattttccacttagtatttttggactgtggctgaccatgggtaactgaaaccgtgtgtaagggggactgttgtgaggggctgtgcacaaatgcttcccagctcttgagggcctggacgcagtgacccgtgcactcagggtcttggccctgataccattctgtaaccaaaaggaaccagggccaggccagagaaggtatcagatgagctagagagtgaagaattgctgggatgaggagacttgttgaaataacacggggggatgggaaggagcatacggtggccagcctggggcagtgtgagcgtgaaaataaacaggctgggcgcagcggctcacgcctgcaatcccagcactttaggaggccaaggtgggaggatcacttgaggctaggagttcaagaccagcctgggcaacatgggtgaaaccctgtctctacaaaacaagaaaagtcagccgtgcgtggtgtcacccgcctgtagtcccagatactcaggaagctgaggcaggaggatcacttgagccagaggttaagtctgcagtgagctgtgattgtaccactgctctccagcctgagcaacagagccggaccctgtctcaccaaaggaaaa

SEQ ID NO: 433143 - DNA, 726 bp, Homo sapiens
ggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggaaattattcagaaaaaaaaaaa

SEQ ID NO: 433144 - DNA, 2075 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433145 - DNA, 2026 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433146 - DNA, 1989 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433147 - DNA, 1919 bp, Homo sapiens
tgtgtgatagaagagggtgagatgctgcccaggtgtgtggctgtggttgggtccctgtggtgctgctctggaaagggggtgagtgtatgtgtttagactgtgggctgtgtacaccctgaagttgtgtgtctacaaaagctgggttgtgtgtgttgtatgttgtcctaaaggagcgtgtgaccatgagaggggtgtgtctgtcactggaggagtacagagtccatctggggcctggtggtggtgggctgtggattggtctggggtgtcccttgggccgatgtgagtcctgaccccttcttctccttcctagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433148 - DNA, 1904 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433149 - DNA, 1791 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433150 - DNA, 1446 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433151 - DNA, 1358 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433152 - DNA, 1570 bp, Homo sapiens
cgggagcaggtggaggactggcggcggtcgagatcgtgctgccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtgagctggccttgggggcaggtggcaaatgggaaggggaaccaaaggaacatggggtccccccaaccctccctcctggcgtttgaaagaaacctggaactccagattatgggtcttgggtattccctattgatggggaaactgaggcctagggtggcaaaggacaccctaagggtacacagggactcaaccccttcacctctaaccctcaaggattagcatttgtgaagctgaaattctttgatctggtcctcaaatgccgggaaggacctgaacaaatgagatgaggttgtcttcaggttcccaccaccctgctctccacccatacctctactcagtcttccatcctccccacattcctcccggggagcccagctggctcttctaattttacctgttaggagccccttccttcatcaaaactcccctagcatatgcccatgtcatccggggccagtatggctctgctcagatagagaacatcgagccgttctctgccaaagacctgtccagtcgctcactgggggtccgaatccgggataaaag

SEQ ID NO: 433153 - DNA, 609 bp, Homo sapiens
caacactcttctatctccctgcccaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtc

SEQ ID NO: 433154 - DNA, 429 bp, Homo sapiens
tgctccctgctctgtctcccgccagaataggggctgctgttgggggcaggaagcgtttctttctcatctctgtatcctcagccctagcatggtatctggcaccagcaatgaataaatgagtgaatgaatgaatgacaagacagagagagaaggaaaggctacatttataaagggcatcaccttcccattccctgtttaatcctcacgacagctccacgaagacacggccattagcatccccatttcacagaacaggagactgaggctgaggctccccaaggttcctgacttgctcaaggtcatacagtatgcaggaggcaggtgctctgttctgccagcttgtcccagtggagggccttcatggggtggcccacggctctgggtgtggagggcctgggccagcgtctgcagtctggctctgtccctcag

SEQ ID NO: 433155 - DNA, 4005 bp, Homo sapiens
agcggagcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaa

SEQ ID NO: 433156 - DNA, 3714 bp, Homo sapiens
agcggagcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaa

SEQ ID NO: 433157 - DNA, 3502 bp, Homo sapiens
agcggagcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaa

SEQ ID NO: 433158 - DNA, 5990 bp, Homo sapiens
gggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgtt

SEQ ID NO: 433159 - DNA, 7363 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433160 - DNA, 7583 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttaggtgagtagagaaacaacgtaattaaaactggtttgtgacttcttttcagtctctgaaaagtcagaagaatagagaaacaagggtaaattattggctaatttttttttattcttttactaccgttccactcgaaagaaaatttttaaagctttaaaaaaaaacgtatttcagaagtgtaatttttgctgtcttctctatcattaccattaaattttatcagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433161 - DNA, 7676 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttaggtgagtagagaaacaacgtaattaaaactggtttgtgacttcttttcagtctctgaaaagtcagaagaatagagaaacaagggtaaattattggctaatttttttttattcttttactaccgttccactcgaaagaaaatttttaaagctttaaaaaaaaacgtatttcagaagtgtaatttttgctgtcttctctatcattaccattaaattttatcagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggttataaatgaagtggagaaagcacccaaagagctgagaaaagagctcatgaaacgcaggaaagaggagcttgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433162 - DNA, 5807 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggttataaatgaagtggagaaagcacccaaagagctgagaaaagagctcatgaaacgcaggaaagaggagcttgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgtt

SEQ ID NO: 433163 - DNA, 4400 bp, Homo sapiens
aagtgtcgaatgctgatccaggagaatcaagagctgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433164 - DNA, 3440 bp, Homo sapiens
gccgcctcacgacgaggatacagtgcgctgaatcatgaccggtcttgctctttcttgagtctgtctgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433165 - DNA, 6046 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 433166 - DNA, 6164 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtg

SEQ ID NO: 433167 - DNA, 6223 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggtttatgctgtgatcgtggtgatttagagggtgaactcactggaacggggatgcttgcatgtgtaatcttactaagagctaatagaaaggctaggacctaacctataatagtttatgctgtaatagtttatgctgtaatagtttatgctgtaatagtttatgctgtaatagtttatgctgtaatagtttatgctgtaatagtttatgctgtatagtttatgctgtaatagtttatacttt

SEQ ID NO: 433168 - DNA, 3294 bp, Homo sapiens
gggccttgcgccgcgggagcggacggcggcggaggagaccctaggctcgcggcccgaggcgggagggctcggcttctcgactgcccgcctccgaggccgccggccgcttctctctcccaagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttaggtgagtagagaaacaacgtaattaaaactggtttgtgacttcttttcagtctctgaaaagtcagaagaatagagaaacaagggtaaattattggctaatttttttttattcttttactaccgttccactcgaaagaaaatttttaaagctttaaaaaaaaacgtatttcagaagtgtaatttttgctgtcttctctatcattaccattaaattttatcagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggagaacaagagttagtacagcatattctgaaattgggacaactctttctcttgctccc

SEQ ID NO: 433169 - DNA, 246 bp, Homo sapiens
ctatgtcagcctcccaaagtgctgggattacaggtgtcagccaccagacctagcctaacttcttacaagttattttgtgcctagtattttgctggtcactgcaacaagggagagggtaattataggaaacaacaataacaaaatgacatatttgaatatgcatgtgggtactgactattgtttctgcgtcactggattctatttaaaactttcataggaaacagagcaaatgcagcgttacaatca

SEQ ID NO: 433170 - DNA, 543 bp, Homo sapiens
gaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagtaagtgtacatgagtcattgtttgggttttcctttgccattttc

SEQ ID NO: 433171 - DNA, 1162 bp, Homo sapiens
gggaattgctggatttatttatttatttatttatttaatttatttatttattttgagacagagtctccctctgttgctcaggctggagcacagcgttcacaactcatggttatggagccttacctgggcatgccccccgctgacacctgtggaaaggcatgggacagccccggcccatcccctgctgcctgagccctcccctcctctgaccttcctccttccatgaccctgctgccaggggggcttcccaaaaaagatcttgagtcttagcgatgtggtcgacacgcagagaacttggagcctcatgccagggccccctcccagagattcctggcgcccatgtctccttggggggtgactgaaggggatgggtccagactcacttgatcaacaggacatgggcctgcagcttcctgatggaatgcgcacacagctccctgctgacgaagtcaatgctgttctctgcctgcagagacaaaaacatggtgaattctcgtcacaaggcacaggcactctcgtgggcacgaaacccatctctgttggggtggctaagccctggcgagggcaccttagccacccaccctgggtctgagcccaggaccccacatcactgcctcatcgaaggctctttagcccctggtggccagagactcctgccctctccaagtctgttctcccctcttcctgggctcgtggctacccagcctgactccatttccaatactcctttgccaccaggtatggctgtgtgattaaagtcagagaagtgagttgggccaccttttgggcctggattttaggacttaggtgtggcccttccacacccctttcccagtccataggctgcacctcacgctgtcccctgccagcctgggacaggcttcttgccaggagaaagaaacttgctgggaccacagtgcaggatgggcactccgtgatggccccagccagcctcctccgcggccctgcctgccctgtcttgtgactgttttacgtctggatggcggggatgtggccagcttgagtgagatgtgctgtaggtgtgacacgaagctggatttggaaaacagcatgcaaaataatgcaatcaagctttatgttgattacatcttaaatcacattgtggatgttaaataaaaatatgagaagaatttatagaacc

SEQ ID NO: 433172 - DNA, 922 bp, Homo sapiens
  misc_feature (771)..(771): n is a, c, g, or t
  misc_feature (778)..(778): n is a, c, g, or t
  misc_feature (811)..(811): n is a, c, g, or t
  misc_feature (821)..(821): n is a, c, g, or t
  misc_feature (859)..(859): n is a, c, g, or t
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacacttatttcatttgattatttagactatnatttggntctactaacctttggttaggcatttggcctacngatttggttngtttgttttcccaaaggggggtccccccattttcaacnaattggcgaaggggtgacccggtggtaattgcgaaaaaaaaaggggcccaaaaactggcgaag

SEQ ID NO: 433173 - DNA, 584 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagatatgtatccttttaacgatgctttctaaatatgagttaggaggaaatgaataatgctggggttgataaagattaatttctggttaaaatgataactttctggattacagtacttaaaaaacaaacatgattagcattttcatggaccaatgcataggctctaaataatctaaataatgctagttgattttggttctcataaatttattttttagggattctgtgcagtcaagcttgaggatagggatacattctgagaattgtgtccttaagcaatttcatcattcctacagaaac

SEQ ID NO: 433174 - DNA, 1064 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaaccccaaaaaaaaaaaaatcacaaaaaaccacgtccccccgccttgaccacccgaaagcctcgggcgccc

SEQ ID NO: 433175 - DNA, 943 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433176 - DNA, 845 bp, Homo sapiens
cgtgcgtaatctagaaattataccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433177 - DNA, 951 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagatcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433178 - DNA, 732 bp, Homo sapiens
tgtccttaactcaaattaatacagtggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433179 - DNA, 732 bp, Homo sapiens
gcggccgcctactactactaaattggcggcccgtcgaccgacacctggactagccgggttgtatttggaaacgcggagtgagtttttccgtgctgtgtaggtaagcgaattggcgggttgaggtttgtggtggatatttgggccaaaactggaaagacacttggggtaaaaaggtccggtatgggggtagagttgagagtggctggggatacggtccatgctatcgctcttttccctattttcttttagtttagatgtttagccagtaggagttatttcattgttcttcgctcggtgagcctgttcccctgttgagggatataattttttttggctaacttctgctagagtttgggaaaatagaacttgtgttaaacgagaacgcgagctttacagtcagatctgtatccctttgacttttagtagctgagtgatcctgcggaaattaacatgtctaagtatcggttgcgtcctctgtaaaacaagagtgatgtctcctaggattgttatgaagattataatggcctaacacgtatgaagtagttattatgtccagtttggggtaaacgctcaatacttgtgtgtatgcgtttcgtccttgagacctaacccataggatttggggaaaggaacagattaggaattggatctttgtagcttttcctgagaaaaatgggcccggatggacttgtgagaagcccttttgagatattcagtatttgagtctgtgat

SEQ ID NO: 433180 - DNA, 971 bp, Homo sapiens
gcggccgcctactactactaaattggcggcccgtcgaccgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433181 - DNA, 609 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtg

SEQ ID NO: 433182 - DNA, 997 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacc

SEQ ID NO: 433183 - DNA, 561 bp, Homo sapiens
gcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattacta

SEQ ID NO: 433184 - DNA, 701 bp, Homo sapiens
gagggagagggaaaacactttaggttgagtgctgagagaaaggctctctgagtaggtgacatctgaactaagagctgaagcagaagaataagccatcctctgtggaccaaaggggacaagattctctacttttctgctacgcactaggaatatagcagagaagacaagtggctgctaccttctgttatcgtgggtggcagtgactagtttttctagatcttgactccctgccgtaactaaagatggagtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattacta

SEQ ID NO: 433185 - DNA, 2531 bp, Homo sapiens
gcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433186 - DNA, 2671 bp, Homo sapiens
gagggagagggaaaacactttaggttgagtgctgagagaaaggctctctgagtaggtgacatctgaactaagagctgaagcagaagaataagccatcctctgtggaccaaaggggacaagattctctacttttctgctacgcactaggaatatagcagagaagacaagtggctgctaccttctgttatcgtgggtggcagtgactagtttttctagatcttgactccctgccgtaactaaagatggagtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433187 - DNA, 740 bp, Homo sapiens
gcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagtt

SEQ ID NO: 433188 - DNA, 977 bp, Homo sapiens
gcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaccaaaaaaaaaaaaaaaaaaaaaaaaaaaaaaaaaaaagggggggggggggaaaaaagtttccccgggggggcgccaagtttggggttccccgtttttttgtgacaaggggggcccctagggggggggatttaaaggaaggacgggccgcggttaaacaggctgtggcgcgggcacccggccgccgggctcttggacagacctccctctggccggggccaattcggacccaccctcagagataaccggctaaggaacataccttcacggatacggttaccccgcgatcggtcggggaagtggcggttgtatagtgcggccactcagcaacagggagggacgaaaggcaccctcaaaggcaacacacagacagcaacagcgagagcgaaaaacaacaggcatgaacaggcgccgcta

SEQ ID NO: 433189 - DNA, 410 bp, Homo sapiens
gttctagaggacccccaagcagttaatacagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgacctgagtctgtattaactgcttggggatcctctaacgtc

SEQ ID NO: 433190 - DNA, 462 bp, Homo sapiens
  misc_feature (1)..(1): n is a, c, g, or t
  misc_feature (6)..(6): n is a, c, g, or t
  misc_feature (443)..(444): n is a, c, g, or t
  misc_feature (450)..(450): n is a, c, g, or t
ncgaanggtaaccgttcgtacgagaatcgctgtcctctccttgcggccgccagtgtggtggaagtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactcatacagtctgccctggctccagtatccctcaaaggtgtttnnactggncccggtatagac

SEQ ID NO: 433191 - DNA, 2120 bp, Homo sapiens
  misc_feature (1)..(1): n is a, c, g, or t
  misc_feature (6)..(6): n is a, c, g, or t
ncgaanggtaaccgttcgtacgagaatcgctgtcctctccttgcggccgccagtgtggtggaagtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433192 - DNA, 1888 bp, Homo sapiens
  misc_feature (1)..(1): n is a, c, g, or t
  misc_feature (6)..(6): n is a, c, g, or t
ncgaanggtaaccgttcgtacgagaatcgctgtcctctccttgcggccgccagtgtggtggaagtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433193 - DNA, 1129 bp, Homo sapiens
gcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433194 - DNA, 672 bp, Homo sapiens
taacactcctatatatcggtaatacacactaacagtcactcccaccgtggagttttactcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433195 - DNA, 386 bp, Homo sapiens
tgacagatacgatcgagccggtacccgatgagtaatctggccagttcaaggcggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaa

SEQ ID NO: 433196 - DNA, 435 bp, Homo sapiens
ttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgaaaaaaattgtgagtgtatttgttttctcccaaagccctgttctacatatttggacaaatgactcataaaattatagatacacttatttaggaaaaaaggtgattcgtgaatggaaatgccatgaaacaataaaaatatgaagcattatttatttaaaaatattatagttatcttagggattctatactggctgctgtacattgttctaaatttttgttatgttggcatcattttgagagca

SEQ ID NO: 433197 - DNA, 5984 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatt

SEQ ID NO: 433198 - DNA, 2155 bp, Homo sapiens
  misc_feature (612)..(612): n is a, c, g, or t
taccaagaaatccagaaatagagaatagttagcattaattcagcattaattgcttagcaatgctgtttgaaaccccagcttgttttgtttttttcctctgtcagtcttatttattggctggttattaatcctcatccttgttgacttacggtaataggatggttgttgcagcactagatactgtgtacacatacgaggctagaaaaatgggagagtggtggtgtcagatgtatttgctcccttttatcaggaaagcaaatgtttttccagaattaaccggcacttcacccccaaagcagacttcagaatataagtctttgattttcactgtgttacccatttcttgtttacccctccaggcatggaaagctcaaaagtggtaattgagctgggccccttactgccctgaatagtctagagtcttgaaaggaaggccaggtcacacctgtaaacccagcactttgggaggctgaattgagtgggaggattgctgagccaggagtttgagaccagcttgggcaacatagtgagagactgtctacacacacacacacacacacacacacacgaaaaaagaaaaacaggttagctgggtgtggtggtgcacgcttntagtcccagccactcaagaggctaaggcaggagaatcctttgagcccaggaggttgaggctgaagtgagccgtgattgtgccactgcattccagcctgggtgacagagcaagaccctgtctcaaaaaaaagtccaggcgtggtggctcacgcctgttaatcccagaacttcgggaggccaaggtggttggatcacttgaggtcaggagtttgagaccagcctggccaatatggcaaaaccccgtctctctaaagagttagccaggtgttgtggtgcacacctgtaatcccacctactcggcaggctgaggcaggagaatcgcttgaacctaggaagtggaggttgcagtgagctgagattgtaccactgtactccagcctgggcaacagagtgatacgtctccaaaaaaaaaaaaaaaatcttagaagggaaaataaatcccataaacaattaacagtgcctgccacatagaactatgaaaaattactaaaatataattggccattcgagtttatttgcttggaaagttatttctcagtaagttcaaattaatggcattttaatggtaggtgaaagagtatttatataatgagggctctcaagagtttataaatgtatgaagactatccactataaagatagccatttggctgggtgcagtgtctcacgtttgtaatcccagcactttgggagactgaggtgggagaatcgcttaaggccaggagttcaagaccagcatggccaacatagtgagaccctgtctctaaaaaagtttttttaaaattagctgcgtatggtggtatacacctgtagtcctagcttctcaggaggctgaggtgggaggattgattgtgcccaggagtttgaggccgcagtcagtcatgtttgtgccattgggctgcagtctaggtgacagagtgagacccagtctcttaaaaaaaaaaaaagctagtcatttatttagaagctggtaaatatgtgtgtgtgtgtgtgtgcatacacttgtgtgtgcgtttttaagaggctaatattttggtttgactatttggtcttaactgttttcagtttacagaggttaatttttgagaagtttaatttaacttttatataaattaggtatttaaagagatgttccttaaagtcataaagatccgtttttattgttaattttggttctttttttgctttccatagaatgttggctcaattaagaaacatcagggagataaattcaacccagtggtaagtaacttcaatttcttttggtagaaagttttcagcagccagttgcagtggcacatgcctctaatcccagcactttgggaggtcagtgcaggagtttgagaccagcctgggtaacatggcgaaacccccatctctgtagaaattacaaaaattagccaggcatggtggctggtggcatggtagtacccttgggaggctgaggtgggaggatcgcttgagcctgggagatcgaggctgcagtgagccaagatcgcaccactgcactccagcctgggcaacagagtgtgaccctgtttcc

SEQ ID NO: 433199 - DNA, 323 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagtctttcagctcacagcaggatgctaatccatgaaggtgacctcgcagtactggttaattaagctttattgctcactg

SEQ ID NO: 433200 - DNA, 7589 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433201 - DNA, 7626 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433202 - DNA, 8173 bp, Homo sapiens
taccaagaaatccagaaatagagaatagttagcattaattcagcattaattgcttagcaatgctgtttgaaaccccagcttgttttgtttttttcctctgtcagtcttatttattggctggttattaatcctcatccttgttgacttacggtaataggatggttgttgcagcactagatactgtgtacacatacgaggctagaaaaatgggagagtggtggtgtcagatgtatttgctcccttttatcaggaaagcaaatgtttttccagaattaaccggcaactttgggagactgaggtgggagaatcgcttaaggccaggagttcaagaccagcatggccaacatagtgagaccctgtctctaaaaaagtttttttaaaattagctgcgtatggtggtatacacctgtagtcctagcttctcaggaggctgaggtgggaggattgattgtgcccaggagtttgaggccgcagtcagtcatgtttgtgccattgggctgcagtctaggtgacagagtgagacccagtctcttaaaaaaaaaaaaagctagtcatttatttagaagctggtaaatatgtgtgtgtgtgtgtgtgcatacacttgtgtgtgcgtttttaagaggctaatattttggtttgactatttggtcttaactgttttcagtttacagaggttaatttttgagaagtttaatttaacttttatataaattaggtatttaaagagatgttccttaaagtcataaagatccgtttttattgttaattttggttctttttttgctttccatagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433203 - DNA, 9186 bp, Homo sapiens
  misc_feature (612)..(612): n is a, c, g, or t
taccaagaaatccagaaatagagaatagttagcattaattcagcattaattgcttagcaatgctgtttgaaaccccagcttgttttgtttttttcctctgtcagtcttatttattggctggttattaatcctcatccttgttgacttacggtaataggatggttgttgcagcactagatactgtgtacacatacgaggctagaaaaatgggagagtggtggtgtcagatgtatttgctcccttttatcaggaaagcaaatgtttttccagaattaaccggcacttcacccccaaagcagacttcagaatataagtctttgattttcactgtgttacccatttcttgtttacccctccaggcatggaaagctcaaaagtggtaattgagctgggccccttactgccctgaatagtctagagtcttgaaaggaaggccaggtcacacctgtaaacccagcactttgggaggctgaattgagtgggaggattgctgagccaggagtttgagaccagcttgggcaacatagtgagagactgtctacacacacacacacacacacacacacacgaaaaaagaaaaacaggttagctgggtgtggtggtgcacgcttntagtcccagccactcaagaggctaaggcaggagaatcctttgagcccaggaggttgaggctgaagtgagccgtgattgtgccactgcattccagcctgggtgacagagcaagaccctgtctcaaaaaaaagtccaggcgtggtggctcacgcctgttaatcccagaacttcgggaggccaaggtggttggatcacttgaggtcaggagtttgagaccagcctggccaatatggcaaaaccccgtctctctaaagagttagccaggtgttgtggtgcacacctgtaatcccacctactcggcaggctgaggcaggagaatcgcttgaacctaggaagtggaggttgcagtgagctgagattgtaccactgtactccagcctgggcaacagagtgatacgtctccaaaaaaaaaaaaaaaatcttagaagggaaaataaatcccataaacaattaacagtgcctgccacatagaactatgaaaaattactaaaatataattggccattcgagtttatttgcttggaaagttatttctcagtaagttcaaattaatggcattttaatggtaggtgaaagagtatttatataatgagggctctcaagagtttataaatgtatgaagactatccactataaagatagccatttggctgggtgcagtgtctcacgtttgtaatcccagcactttgggagactgaggtgggagaatcgcttaaggccaggagttcaagaccagcatggccaacatagtgagaccctgtctctaaaaaagtttttttaaaattagctgcgtatggtggtatacacctgtagtcctagcttctcaggaggctgaggtgggaggattgattgtgcccaggagtttgaggccgcagtcagtcatgtttgtgccattgggctgcagtctaggtgacagagtgagacccagtctcttaaaaaaaaaaaaagctagtcatttatttagaagctggtaaatatgtgtgtgtgtgtgtgtgcatacacttgtgtgtgcgtttttaagaggctaatattttggtttgactatttggtcttaactgttttcagtttacagaggttaatttttgagaagtttaatttaacttttatataaattaggtatttaaagagatgttccttaaagtcataaagatccgtttttattgttaattttggttctttttttgctttccatagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433204 - DNA, 7882 bp, Homo sapiens
ttttctaagagactgggtctcactctgtcacctagactgcagcccaatggcacaaacatgactgactgcggcctccacctcccgggttcaagccattctcctgcctcagcctcccgagtagctgggactacaggtgcccacacctcgcccagctaattttttgtatttttaggagagacggggtttcactctgttagccgggatggtctcatctcctgacctcgtgttccgcctgcctcggcctcccaaagtgctgggattacaggtgtgagccactgcgcccggcctcaaagcacagtttttgaagaagcatgtaaatggctacttcatggattgctttgtgaagtactaaagagcttgagtttaatttgaaatccagtagttataaatgtgggtattaaagcaatgttaaatgggttccattgtgcttgtatagtggcaggagaagtgtttatctgtgacatatgaattgtgatagattggaatgatttgttctgaaaaaccgttgtaatatgtatgttttaaatttctttttattcgaatattgcagtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433205 - DNA, 6680 bp, Homo sapiens
aaggacaggatgagggaatagaacattgggattgggagtggtatctcttttagatacgtttgttaggaaagttgtttctaattcttgtcagatgtagtatgtctcacactgactgttggtggacttgcttctattttaagctgaaaaattgtatgttgtttcttccctcattaggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433206 - DNA, 6367 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatct

SEQ ID NO: 433207 - DNA, 7749 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433208 - DNA, 8092 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgtaagttttctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgatttttaactttcttattgctttttcacacacctataaaagtaattttattactctcaagagaaatcactaaagtcagaattactagaggtaaaaataactagtttgttacagtattactcagagaagtcagggagaaaacttgtaccatgattcaaatatttgcatggtgtggaggaaaaattgctccttggtactctgttatttatacatactgtttttagttaaataattttttttgttgttaaagggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433209 - DNA, 3540 bp, Homo sapiens
tggtactgggaatagagttccaaatttaaactcagccaggacaattgggatgataatattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433210 - DNA, 6429 bp, Homo sapiens
  misc_feature (6190)..(6190): n is a, c, g, or t
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattgggnattaaaactatacagtacaataaccaattgataacatcttgaaagaagtgcaatatttggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatct

SEQ ID NO: 433211 - DNA, 2291 bp, Homo sapiens
gttgagattgtgttgccgtgtgacacagaatgttcatcgagagagattaagaaaagtcctctgtgaggtagtttggtcatactattggcttgtgtaaacaagtgaattgatggaagacatgttacacttgtggagcttaggtagaactccagagactaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaaaaaaaaactcggtgttccctttattcttagtttgtttttaaatattaatttgggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaaaaaaaaaaaataaaaaaaataaaagaaaataaaaaaataataaaataataaaagataaaaaaaaataacaataaaaagaaaaaaaaaaaaaaatgaacacaaaacaagaagacgtcgaacgaacaaagacacaaaacactagaaagataagacgaaaagtagaaaaacaagagaagggacagaaatcaacagaaacgtacaaaaaacagacaatcagaacccagaacaaaatcaacagaatcaaaagaagagagatccagaggcaatcagaagcaacacaacaaagaaacaacacacaaccaaaggaacgcacgaacatcacaaacaaacgaacgctaaaagaacatatcaaactccaacacgcaacaaataagcagcaggtacaaaggcacacaaaaaactaggcacaaaccgcacgacattaagatacagactgaaaaagacacaggccatgagcatgtagccggcgaagcacatccagcacagccacaccgggccaacaagaaaacacaaacaggaatgcaaaacaaacaggagagcaagaaagaacaacaggaaagcagacagacacagaacaaaaatacacagagacaaaacgacagcaccacaccaaccactgacagaacaactacacacaaaaagacgaaaaccaaacaccaacaacacacaacagagagacaaacgagaaccaaaaacaaaacatcaagacacaacaa

SEQ ID NO: 433212 - DNA, 5191 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgtaagttttctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgatttttaactttcttattgctttttcacacacctataaaagtaattttattactctcaagagaaatcactaaagtcagaattactagaggtaaaaataactagtttgttacagtattactcagagaagtcagggagaaaacttgtaccatgattcaaatatttgcatggtgtggaggaaaaattgctccttggtactctgttatttatacatactgtttttagttaaataattttttttgttgttaaagggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggtgatggacacctgtgatactgccaatttctccacttcactgctgccatagacaatgtagtgattttaagggaaagaagtgaccttgagtcagccattttcaaatataatagcaaatatttggccaccagcaactagcggagaagtctgaaagcaggaattgtgtataattcaaaaccaaatatgatttctgaagtagttattttgaaaaggattgaaatatttcaataaatatgtctttgaatatact

SEQ ID NO: 433213 - DNA, 2274 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaaggttagatgttaaaggaaagtgctaagaatagaaattgcctcaataaatttataaatttttttgaaata

SEQ ID NO: 433214 - DNA, 611 bp, Homo sapiens
gtgcctgctgatttcagagttataccctaaatatatttttatgtattgtggctcattcatagttgactgttttgttcatattttacattattaaaacaaatattacctcattttctgtttacaaagtgatgaagatacattgaaacaagtaggttattataaaaggcaaatctttgaaggggctctcataaaagtagccactcataacagaagcgactgttttctgtctgttgggaaaatatcttgtgagagtcttagattttaataaaagactgaatttcttacatgaacttaacttaaattctggtattttatgtaggctccctgatggattttctcagctgttaaacctaacccagttgtatctgaatgatgcttttcttgagttcttgccagcaaattttggcaggtaaattatggtttcttctaaaacgttttattattagctcttataaagtttacaaaactataagctgctttggtagtactactcattacagtttcataggctctttttaaattattcccaagcattgtgacttttatactttgtttggtggctttgacttaatttttccaagtaaacaataatcagtgagagtttgaaagaa

SEQ ID NO: 433215 - DNA, 2648 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctag

SEQ ID NO: 433216 - DNA, 1209 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctg

SEQ ID NO: 433217 - DNA, 570 bp, Homo sapiens
  misc_feature (467)..(467): n is a, c, g, or t
  misc_feature (479)..(479): n is a, c, g, or t
  misc_feature (492)..(492): n is a, c, g, or t
  misc_feature (519)..(519): n is a, c, g, or t
  misc_feature (526)..(526): n is a, c, g, or t
  misc_feature (558)..(558): n is a, c, g, or t
ggcgaggccatgtgatgctgggcgagagagagccgccgcgccggagcctccttctttcctgcctctgattccgggctgtcatggcgacccccaacaatctgaccccccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagttaccccggaagttgttnggaaggcaattncccattggattgncttaaaaggattgggttgcattcttgnatttccnaaggtttaacaaccaatttcattgattccccnaaattaagggca

SEQ ID NO: 433218 - DNA, 1068 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgagggtgggtgccagccctgggggaggtgggggctgcagcccacccagcctactcttcccctgcccagtctcagcctcttttttccgcaaaagtctcagaggacctcccaggtggttaagaggatgggctatggagtcagactaaggttcaagtcataacttggccacttcctagcttagtaaatgtggtcaggttctcccctctctgaaattcagtttcccatctataaaa

SEQ ID NO: 433219 - DNA, 2498 bp, Homo sapiens
acccttgcagggagcctgacactgagggctggcggcttttctggcgcgggccagggggaggaggagaaaggagctcccgggatcccctcgccccctcccccaactgcccggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctag

SEQ ID NO: 433220 - DNA, 2893 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggaccccgcctggcagcaagtctggagctgagaggagctaaccctcggggacagcttggcagagcccagtgaggagagatggccgggccaccactagaatcccctgtccgccagcagccaagcccgagcatgggggtgcccagggcctctgggcagagacatcttggggctcagggatgccgggggcaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctag

SEQ ID NO: 433221 - DNA, 2474 bp, Homo sapiens
ggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctag

SEQ ID NO: 433222 - DNA, 1012 bp, Homo sapiens
tacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggcctgaacatgtcgaggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctc

SEQ ID NO: 433223 - DNA, 942 bp, Homo sapiens
tacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggcctgaacatgtcgaggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcatcgacatgttcggggtcctctaggtacacg

SEQ ID NO: 433224 - DNA, 7412 bp, Homo sapiens
ggcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcggaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataagaaactgtgaaattgagcttactgagtagaaaatgagaatactaaaaatgtgaagtttggagggtatgtattagatcatttctaatggtcctcaaataatgatcattgcctgcctgactatgtaagattcttgttgggagcttaagaatagattcctgagctaggcctttggagactctggcatgctgtgtctaggagggagtctgtaaaacaatttttaatgaagaaatttaaaaattacacaaaactagaatagtgcattggtactcaacatccagatctgacacttatcactatcttaccatgtttgcttcatttgtcatttttttgtttgcttaagtatcttaaaatcccatacattgtgttatttcactgctgtgaacactttgggtagataccacgatatcacacctaacagaggcagcagcagtccttcggcttcatctcatagccagtccttaagcaaatttccctgattatctcaaaaatcatcttctagttggtttgttagaatcaacagaatataagtcacatgatgatttcgtttttaacaatcacctcagatgactttgatgttagctactttgagaaccactggaaattattttgccaacttgaaagttcaagttaggataccacaattcttggcacgtttggtggattataaatgtgattttgaaatattagaggaagcatttggggttaatgacaggatatgaatttatattagtaagtttgataagataaaatttcctcagtgaacggagaatctcagccccatgggctctaattgattgggacttgtgtagagcgtggtcacagtttaatccaactggactgtatgctgtggtctcactcatgttgtggcttatttacactgtcacacacactacattgtggatcagttggaaggttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttaaccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttctgttgttttctgtacagagcgttcagtttactcaggctgaatgttttctgacatatatctccagtatgaatttgtttatgtaaggaagagtttttcaggaagagaaagtagagaagaaaagaatgatgtaactaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaaaaaaaag

SEQ ID NO: 433225 - DNA, 7505 bp, Homo sapiens
ggcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtgtaaagatttctctctgtgttactggaatccctattggatgctgccctctgatgtttgtggaatgaactgcttttgggaagcggcttttaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcggaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataagaaactgtgaaattgagcttactgagtagaaaatgagaatactaaaaatgtgaagtttggagggtatgtattagatcatttctaatggtcctcaaataatgatcattgcctgcctgactatgtaagattcttgttgggagcttaagaatagattcctgagctaggcctttggagactctggcatgctgtgtctaggagggagtctgtaaaacaatttttaatgaagaaatttaaaaattacacaaaactagaatagtgcattggtactcaacatccagatctgacacttatcactatcttaccatgtttgcttcatttgtcatttttttgtttgcttaagtatcttaaaatcccatacattgtgttatttcactgctgtgaacactttgggtagataccacgatatcacacctaacagaggcagcagcagtccttcggcttcatctcatagccagtccttaagcaaatttccctgattatctcaaaaatcatcttctagttggtttgttagaatcaacagaatataagtcacatgatgatttcgtttttaacaatcacctcagatgactttgatgttagctactttgagaaccactggaaattattttgccaacttgaaagttcaagttaggataccacaattcttggcacgtttggtggattataaatgtgattttgaaatattagaggaagcatttggggttaatgacaggatatgaatttatattagtaagtttgataagataaaatttcctcagtgaacggagaatctcagccccatgggctctaattgattgggacttgtgtagagcgtggtcacagtttaatccaactggactgtatgctgtggtctcactcatgttgtggcttatttacactgtcacacacactacattgtggatcagttggaaggttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttaaccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttctgttgttttctgtacagagcgttcagtttactcaggctgaatgttttctgacatatatctccagtatgaatttgtttatgtaaggaagagtttttcaggaagagaaagtagagaagaaaagaatgatgtaactaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaaaaaaaag

SEQ ID NO: 433226 - DNA, 7358 bp, Homo sapiens
ggcggcagaggcggtgtccaggcttccgggcgggtagtccttcggctccggagccgcgactgcgctcgcctaggtggtgggcggggagggaaggaagggagcgggcgcaaggcggcggcggcggctgcgggtgaggaacttgttgcgcccgcggctgcgcggtgcccctccctccgctccagttcgtcggggcgggcgcggcggcggcggcgaaggaggagcgcggccggggcgatgcggcgctacctgcgcgtcgtggtgctgtgtgtggcctgcggcttctgctcgctcctttacgctttcagccagctcgccgtgtccctggaagaaggaacgggcggcggtggcgggaagccgcaggccgcggtggcttcctggctcgcgggcggcggacgcggcgccgtgagaggcgccggcgtcgcgggccccgcagcgcatcccggcgtgtcggacaggtacagtctgaaaatacagcctgttgagaaaatgcatctagctgtagttgcctgtggtgaaagactggaagaaactatgaccatgttgaagtcagctatcattttcagcatcaaacctcttcaattccatatttttgctgaagatcagctacatcatagctttaaaggcagacttgacaactggtcatttctacaaacatttaattatacgttataccccataacctttccaagtgagaatgcagcagagtggaaaaaactctttaaaccatgtgcttcgcagagattgttcttgccgttaatcctgaaagaagttgactcactattgtatgtcgacactgatatcctttttttacgaccagttgatgatatttggtctttactaaagaaatttaattccacacaaattgctgcaatggcaccagaacatgaggaacctcgaataggatggtataatcgctttgctaggcatccatattatggaaaaactggagtaaactctggagttatgttgatgaacatgactcgaatgagaaggaagtatttcaagaatgatatgacaactgtacgactacaatggggagatatacttatgccattgcttaaaaaatacaaactaaacatcacatggggtgatcaagatctattgaatatcgtgttttttcataatccagaaagcctttttgtttttccgtgtcaatggaattatcgaccagatcattgtatatatggaagcaattgccaagaagcagaagaaggaggaatctttattcttcatgggaacagaggtgtttaccatgacgataagcaaccagcatttagagctgtttatgaagcactgagaaattgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcggaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgttttaaaatatttttatgacaatcatgtttaaaattatttttagattacaagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataagaaactgtgaaattgagcttactgagtagaaaatgagaatactaaaaatgtgaagtttggagggtatgtattagatcatttctaatggtcctcaaataatgatcattgcctgcctgactatgtaagattcttgttgggagcttaagaatagattcctgagctaggcctttggagactctggcatgctgtgtctaggagggagtctgtaaaacaatttttaatgaagaaatttaaaaattacacaaaactagaatagtgcattggtactcaacatccagatctgacacttatcactatcttaccatgtttgcttcatttgtcatttttttgtttgcttaagtatcttaaaatcccatacattgtgttatttcactgctgtgaacactttgggtagataccacgatatcacacctaacagaggcagcagcagtccttcggcttcatctcatagccagtccttaagcaaatttccctgattatctcaaaaatcatcttctagttggtttgttagaatcaacagaatataagtcacatgatgatttcgtttttaacaatcacctcagatgactttgatgttagctactttgagaaccactggaaattattttgccaacttgaaagttcaagttaggataccacaattcttggcacgtttggtggattataaatgtgattttgaaatattagaggaagcatttggggttaatgacaggatatgaatttatattagtaagtttgataagataaaatttcctcagtgaacggagaatctcagccccatgggctctaattgattgggacttgtgtagagcgtggtcacagtttaatccaactggactgtatgctgtggtctcactcatgttgtggcttatttacactgtcacacacactacattgtggatcagttggaaggttcttcatctggtttatttagacctgacctaattgatcattttaccataaattgaattatagtgaaaactgtcttttgggtactgtttctacctaaaattaaaggtatcacaaaatatgtataataatttttaaatgaattttctgaatttatctttagacaaggtaattcttttgaattctaaagaaatgcagttcttggagttgatgagaggttaaattatagatggacaacttagagaacgtattccatcttcatataaatggtctttcataaaacatagtgtatctatgcagtttatataaactacatgatttattatttgagtctatgtattctgacctcagaactatctctgggctacagtattaccaaagtgggatgcctttaaaatgcagtcaaacttcatttgtatgaagtagaaaagaacttgggaaacctttaaaaatatatattgtgatttatgctttaagaaaatgcatacttttttctaatgaagagtagttcataatatataagggttttaaggccctgaaataacattagtgcttactcattgctctctcatcttgcctccagtcagatgttattggtatagtgaaaagaagaccagattttgaactagatctggattctctttttagtaactcaggcatgttatttaaccttctctgtgccttaggtttttaagtacaatcagtgtacccttcaaacctcacaagatgaaactcagaagagataatggatttggaagcattttgcgtggcttatattatgccacgccagtgttactgttgaagttctgttttgttctgttgttttctgtacagagcgttcagtttactcaggctgaatgttttctgacatatatctccagtatgaatttgtttatgtaaggaagagtttttcaggaagagaaagtagagaagaaaagaatgatgtaactaatcaaaaaagaaggaaaagagaggaagtgagaaaaggggtgaggaaagagaaaggagtaagaatggggatggcaaagggcagagtaagagaaaagatggaatgagtgtatggaaaattgagaagtagagatggagagaaatggtgtggaaacatttactttttgagttgtagccctcacactacatcagtttgcttgcctgggctctctggggtcaggaaaggtgctgacttccatggaatggggcagcagggcctgctgtatttggtttgttagtactagagttgtttcccaatcaccctactcactgatcatttagtgccaattcaacattttatgtcttttttttttagtggatcccagtttgtgagctaggacctgtggaaatacaagtatcttcctttttaactttattgttttagccatcccaagtgttagactgcaagactaactacatattccccagtggaggttggaagtggaggggactgcttcattaggtctgaagggggccaaggaatgtgttgcagcagttttcgcagatgatactgacgagaggccaggtttgggaatcactgccctgccttggatggcaaattaagcaataaattacacctatttattcctcagttgggatactttcagttgaaccattctgagtagatttaagagaacaaaagacagcagaaataccttaaaagatattattggctgtcttatttttcagatatttgtatttaataaataccttagtagtagtcagaacctctttgagatgtttttagaaagaccactgatttgttttttaaaataatttttttggttccttagagtagagaagaaaagtaggggtgcaatatgtcaggtgtggggccagttatccatttattaaatgcaatttcaagtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaagaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacgttttatttcctcaaaaaaaaag

SEQ ID NO: 433227 - DNA, 479 bp, Homo sapiens
tttaaaataatggtgccctaagtaagggagaaatcagttttccaaaatctttatcatagcaatttggatttataattttatttgctttaaaatagaacagtaagttatcgtgttactgagtaaattccttgttagctccaaaccaaaatactcacacaggactcttatttctgtcttactctgttaggtgtaaagatttctctctgtgttactggaatccctattggatgctgccctctgatgtttgtggaatgaactgcttttgggaagcggcttttaggtaggcacttaatatttaattggtagatcagtgtagataaggttagatagttgataataaaacctttgtaataggatgtaagaatgtttcttatgatattatacaaataatttattttcttattgggttttctatttttcccattttgtagttgttattgctattttttagtacatactgtgtataaatgctttaaatt

SEQ ID NO: 433228 - DNA, 523 bp, Homo sapiens
acggaaacactgtttcccaatctatagtatagtctaccttcagggttttaaagttctatttaaaataatggtgccctaagtaagggagaaatcagttttccaaaatctttatcatagcaatttggatttataattttatttgctttaaaatagaacagtaagttatcgtgttactgagtaaattccttgttagctccaaaccaaaatactcacacaggactcttatttctgtcttactctgttaggtgtaaagatttctctctgtgttactggaatccctattggatgctgccctctgatgtttgtggaatgaactgcttttgggaagcggcttttaggtaggcacttaatatttaattggtagatcagtgtagataaggttagatagttgataataaaacctttgtaataggatgtaagaatgtttcttatgatattatacaaataatttattttcttattgggttttctatttttcccattttgtagttgttattgctattttttagtacatactgtgtat

SEQ ID NO: 433229 - DNA, 3894 bp, Homo sapiens
gtccggtcggcttttctcttccttcggctgccggcgccagcacgtcctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433230 - DNA, 815 bp, Homo sapiens
  misc_feature (465)..(465): n is a, c, g, or t
  misc_feature (473)..(473): n is a, c, g, or t
cctccccgcgccccgcccccccccgccccttcaggctcagtaccggcctggtggttcaattcggccgcaggattacttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcatgaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgngacctatncaccctccacttcccgtctcagaatctaaacggtggtcaccttcgagtagagaggtccgcccggccaccgtgggcaggtgccacccgcagatgacacgcgctctccatcagccaatccaaaccatgagaattgtgcaaccaggggaaggaaaaaagaaccaaaacttccaaggcctgcttttttctttaaaagtactttaccacggccattcgcggtattttttatttacattctatcatcctccgtcatatggtcgggtcagacatcttcaatgatctcggatgacaaaccagcctcggagcgtctctgtcctactctgggcttactgtggtgtgccctgc

SEQ ID NO: 433231 - DNA, 370 bp, Homo sapiens
atgaaagaaataaattagtattctcatttttttcgttgagcacttataagacttggctttacttcattgagacctccacctttaataatggtagtgattaagattctttcaatgtgggacagaatcccctgatctgaaatagtagctccatttggtcatagaataaatgaaaagtgtccccctttcagacgttccagaagtagagagagagacagaagccgagagcgaagaagatctcgaagtagagacaggagacgctcaaggagtagaagccggggccggcgatcccgatcctccagtctgtccattaagttgaagtagatcatcttaaaggtcttcatcctagttgtcttcacattgagtaggctga

SEQ ID NO: 433232 - DNA, 262 bp, Homo sapiens
tgccggtccccatgcactttgtcaaaagaataaatgaaaagtgtccccctttcagacgttccagaagtagagagagagacagaagccgagagcgaagaagatctcgaagtagagacaggagacgctcaaggagtagaagccggggccggcgatcccgatcctccagtcctggaaataaaagcaagaaaactgagaataggtaatgttatcattgggctgcatctatagtgcagactggggactgcttcccttctctgcgccg

SEQ ID NO: 433233 - DNA, 3534 bp, Homo sapiens
gggaagtataaagcgttgagctcaacgctttatacttcaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433234 - DNA, 3583 bp, Homo sapiens
gggaagtataaagcgttgagctcaacgctttatacttcaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggcccttcaagatttatagaactgggcttccgagacttaaaccatcaaaggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433235 - DNA, 3670 bp, Homo sapiens
atgaaagaaataaattagtattctcatttttttcgttgagcacttataagacttggctttacttcattgagacctccacctttaataatggtagtgattaagattctttcaatgtgggacagaatcccctgatctgaaatagtagctccatttggtcatagaataaatgaaaagtgtccccctttcagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433236 - DNA, 1313 bp, Homo sapiens
gggaagtataaagcgttgagctcaacgctttatacttcaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaataggtacaattcttttcattaaactatttttcaaataacagctttgttgtcaaacagaaagaccttatagtttataatgttcttaattatgacaatgaagttgtctttatgtacattttctttatcaatttggcactttggggctgatttccccttaccagcaggtggagtgagaatcttcagagctctggagtgacatctcagaagtacaaaaacagcctctcctggcacagctcagtttttaaactctgacttggcaggtagactcctcgtgcatctatctgtttatttata

SEQ ID NO: 433237 - DNA, 2965 bp, Homo sapiens
ttgagattattcagctaggagtctggggtgggggttgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433238 - DNA, 2866 bp, Homo sapiens
aaggctgaggtggataattactagtatggggataaggggtgtaggtgtgccttggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433239 - DNA, 1274 bp, Homo sapiens
  misc_feature (924)..(924): n is a, c, g, or t
  misc_feature (932)..(932): n is a, c, g, or t
gggaagtataaagcgttgagctcaacgctttatacttcaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcatgaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgngacctatncaccctccacttcccgtctcagaatctaaacggtggtcaccttcgagtagagaggtccgcccggccaccgtgggcaggtgccacccgcagatgacacgcgctctccatcagccaatccaaaccatgagaattgtgcaaccaggggaaggaaaaaagaaccaaaacttccaaggcctgcttttttctttaaaagtactttaccacggccattcgcggtattttttatttacattctatcatcctccgtcatatggtcgggtcagacatcttcaatgatctcggatgacaaaccagcctcggagcgtctctgtcctactctgggcttactgtggtgtgccctgc

SEQ ID NO: 433240 - DNA, 941 bp, Homo sapiens
  misc_feature (898)..(898): n is a, c, g, or t
  misc_feature (906)..(906): n is a, c, g, or t
  misc_feature (922)..(922): n is a, c, g, or t
gtccggtcggcttttctcttccttcggctgccggcgccagcacgtcctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgccanaagagtancgtggagatgacagcnggtcttgagtagagttagg

SEQ ID NO: 433241 - DNA, 1958 bp, Homo sapiens
tcataggttcgcagggagttgagattgtcgagtatagtggattgagtgctgtggagccgagattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433242 - DNA, 402 bp, Homo sapiens
acagagattaatcaaagatgtctcctagatttttgtcctaagcatgtgtggagttgtcatttcttgagattgggagactgtgggagtggcaaaactgagacagttgttctcaaaagttccttttacttggttttaacattgcataagctttgaagaccatatttaccatatttatttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtggtgggtaccatctttaggaaattcccagtttccttgata

SEQ ID NO: 433243 - DNA, 1479 bp, Homo sapiens
gggaagtataaagcgttgagctcaacgctttatacttcaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaataggtacaattcttttcattaaactatttttcaaataacagctttgttgtcaaacagaaagaccttatagtttataatgttcttaattatgacaatgaagttgtctttatgtacattttctttatcaatttggcactttggggctgatttccccttaccagcaggtggagtgagaatcttcagagctctggagtgacatctcagaagtacaaaaacagcctctcctggcacagctcagtttttaaactctgacttggcaggtagactcctcgtgcatctatctgtttatttata

SEQ ID NO: 433244 - DNA, 3484 bp, Homo sapiens
ctgagattgtgccactgtactccagcctgggtgacagagcgagactccgtctcaaaaaaaacatcatttagcagagaaagtttgtagttctgcatccagctgtatagctgtaaaatctattattggagatcaccttttttggcataattaatcttttgacccttttacaaccaatttatgttttattcatatttattttgtcattgttaatattcagaagtaatacatgcttcatgtaaaaatggaaaaacctcagaatatgagcatttgaactgatggatggctggagtaattggaaaaggggtgtttgggcagtggcagaaaaggttagagaggtggggtgtggtctgattgtgaaatactgcatttttaaacagatgtttaaagaatgtgtattctggtattttagatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433245 - DNA, 2651 bp, Homo sapiens
gtcccatgtagcttggtcaccgcggtggtatggtacagtgacataagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433246 - DNA, 961 bp, Homo sapiens
gtccggtcggcttttctcttccttcggctgccggcgccagcacgtcctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaaaaaaaaaaaaaactcgagactagttctctgtcggcacgcgtgaaacttctccgcggctccgcgaaaacgccgccgagatgcgctaagtggcctcctcacctggtggctcgcctggggggcacttctccccccagcgccaggactccgacgatcttggccagcggggatcgaggggaacacgacggtccaccaggtttcgtggcgatgggacacttgggacttttgcccggtttggattgcgcgtcccg

SEQ ID NO: 433247 - DNA, 1877 bp, Homo sapiens
gttggtttcttctgcatcctctcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagt

SEQ ID NO: 433248 - DNA, 4281 bp, Homo sapiens
  misc_feature (3423)..(3423): n is a, c, g, or t
caaggggccaggaccctgagttttattgggccttgactaatgtgcctcctcatctgtgtcctcaccctcattgtggacttaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtgagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcagcacctgcggtctgcggtggcacctggcagctggaccacagccaggagaagggtactattagccctgcttcaaacatgcagaaactgaggcccggggagattaaataacctgcctgaaatgacaccgtcctgggccgccggacacccccgctggggccgatgcccaacagtgacatcgacttgagcaacctggagcggctggagaagtaccggagcttcgaccgctaccggcgccgngcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgc

SEQ ID NO: 433249 - DNA, 800 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggtaggcagagttcagagtaagatgcatggaaagcgaacatgcctcccatcctgcatccccaaagatcttgactgcatgcaacactctgggggctgggcggcaaggaccaggatggagaccctggagaagagtgacaggaggtggcattgataccaaactttcgacgaccaaggtttcttctgagactctgagtgtccagctggaagcgtttttaagtgtctgtcactggtattgaggagtcaggggcacggaatagaagacatttccggtcacatgacatctcggctgggagggtttgcatgtcgtgtctgggaaaggagtgacctgcccgcccattggcacccatcgctggttagcagggctgtttccacgctctgaatgagtccgttctcagaaactataggaacacataaaggacttacatctctaaatgccattggtgctcttgcctctggttacttggcaaaaggcaacgcaattcattctgcattgccaatttccacctgtgttcactgtttggttttcttgatgtgatt

SEQ ID NO: 433250 - DNA, 595 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaagggtgacgcattgaggggcgcggagtctcgggacggaggggcgactccggctaggggtcttgcttaggggtggtctcgggatctgtaaaacgcctggcatggagtcggctgaatacatgtggggacggggttactctgtagccctttggccttggcaaaccaagcctagaaaatccccatagtctgagaagcccgtacaggatcgataggagatgccagaagttccttgatgtgttatgggacacatttggacttgtaggtcgtgaagtcgccattgcagagaaaaagaaacaaggccgggcacggtggctcacgcctgtaatcccgacactttgggaggccaaggcgggaggatcacttgaggccaggcgtctgggacgaccctgggcaacatagggagacccccgtctctacaaaaa

SEQ ID NO: 433251 - DNA, 4857 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatgcaccaaaaaccaagaaaggatgtaaaggctccattgatgattttcttggtgaccttctaggggatgatatgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 433252 - DNA, 4866 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 433253 - DNA, 3985 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggtagggcccagagcctccggacagtggagggcccagggttgcctgcgcccctccatctggacacatccgcttccagtcttaggaaaggagagtgtagcactaatgtcacaagagcatagggattaaaacagtaatcgcatcatcatgctaacatcttcctcgtattgtcccaggtgcattatacacattttatttgatcctcatgttcccatgactttggtcatttagaaatgaggaaaccgaacttcagagttgagcctgccacagtcacgtggcttgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 433254 - DNA, 1886 bp, Homo sapiens
  misc_feature (12)..(12): n is a, c, g, or t
aattcggcacgnggcgggacgagaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 433255 - DNA, 685 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatgcaccaaaaaccaagaaaggatgtaaaggctccattgatgattttcttggtgaccttctaggggatgatatgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcaggtgggtcagtagccagtgagaaaggtgc

SEQ ID NO: 433256 - DNA, 4816 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgaca

SEQ ID NO: 433257 - DNA, 5787 bp, Homo sapiens
  misc_feature (4929)..(4929): n is a, c, g, or t
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatggctcatcggagtttatacttatttcttagaaaatgtttcctgttatttgctggacaagtcccaaagaacaggcagatgttcttattaaaagatcagcctataagattggtcaggaccaggcgcctctggccacgtgcctctcccctccagcacctgcggtctgcggtggcacctggcagctggaccacagccaggagaagggtactattagccctgcttcaaacatgcagaaactgaggcccggggagattaaataacctgcctgaaatgacaccgtcctgggccgccggacacccccgctggggccgatgcccaacagtgacatcgacttgagcaacctggagcggctggagaagtaccggagcttcgaccgctaccggcgccgngcagagcaggaggcgcaggccccgcactggtggcggacctaccgagagtatttcggggagaagacagatcccaaagagaagattgatattgggctgcctccacccaaagtctcccggacccaacagctactggaacggaaacaggccatccaggagcttcgggccaatgtggaagaggagcgggctgcccgcctccgcacagtgtcccgctggatgccgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggcccagcggaccttccgcacttttgatttctacaagaaacaccaagaaaccatgactccagccggcttgtccttcttccagtgccgctgggatgactccgtcacctacatcttccaccagcttctggacatgcgggagccggtgtttgagttcgtgcggccgc

SEQ ID NO: 433258 - DNA, 3833 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggcaaggctccctgagtgtatggcgcccctgcccccggcacccccagcctcccacctcacagctgagtccttctttctgggggaacggggacaggagcatctgagtctggcccagcagaggctgcaactggaccgcgcacgacaggacctgccctctagcctcgtgggtctgttccccagggcccagggccctgcagcctccagccagagtggtgagtggctccagaaggaagggccggcggctcaggactgggcaggggcagtgctaggagtgggcaggccctcctccagccgctccagttaaggcggccagctgggttttatagtcgccttatttcttttttacacaaataatgtgtgttaattttagataaatcagaaatagaggaacactattatgaaaaatgtcacctttttgtaactctggactcagga

SEQ ID NO: 433259 - DNA, 3732 bp, Homo sapiens
gcggcagcggctggaagcgggagccagtcctggccgggctgggcgacccgaatggagccagggccggcctggtcccagcggccgcacctccgggggcacggcgcgtaacaggaggcttccggggctgagagcgttacaggctgcgctccggggccagataggccgggcgctcagaaggggagtatgagcctgatgtgggcagaatccagatgagctggccagtgctgtgaaggagctgagagcacccccgagagccgtgagatggcaccaaaaaccaagaaaggatgtaaagtgacactacctgagaagcctgttaaactagcttcacataccagagacaccacaggtgtatctcagatgttcccttcttcaaaggcgagaacaaagtccctcctgggtgatgatgtcttcagcaccatggcaggcctggaagaagctgatgctgaggtttcagttatctcagaggcagacccacaggctctgctccaggccatgaaggacctggacggcatggatgctgatatcttaggtctgaagaaatctaattcagcccctagcaaaaaagctgcaaaggaccctgggaaaggagagctgcccaaccaccccaagcctgcagggggtgccattcccaccaagaagtcacttccgtctcccagcagctctgggcatcagaacaggaggttttcctctgaagacttggaagacccattgggaggacttctctcctatgatgaaggaggaatcaccaagcagccgcctgtgacacagagtaaaacagcttctgacaagagccccagcacagtgagagatcaaggtccctctattcctctaactcctggggacacccccatccgaaaaaaagaagaattgttgtttgatgatggggatgacatcatggccaccttggggtttggagacagccccaaagcagagaagaggcagataggagaccaggaagggcctcgccctgctcgctccacgctggatgagctgctgggtcgaggcatggccaccaaactcctggcccgcccgggcaccggggagcacagggagttcaagctagacaagaagtaccagaggccacaggacagtgaagatatgtggggtgacgaggacttcacctttggagcctatcagcccactgtggtctcctctgagggccggcagtcccgccggcagtctgtcagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcagcctgacctgggccttctgtcaccttcaccttgaacgctgcctttcctcagccaacctctcaccagcacacaagggcttgagcacgcagctgctggagggagttctggaacaactgcacgaggaaagaccgtgtgtcaggcctggtgtctcggggtcccctgtgactcagaaccatgccgcctcagcactccctacaggttccccaaagaggggaacagcccctggagacctctcagccactgagcctgccacgtgtttcccgagcacccagaaacccacagagccttccgtgcccgtccagcccctgctcccagagtccctggcccggagcctgctgccgagcacagaataccagaagcagctcctggcagcacaggtgcaacttcagtgcagccccgctgagctccaggccgagctgctgcatagccaggcccggctggcagagctggaggcccaggtgcggaagctggagctagaacgggcccagcatgagctgctgctggggagtctgcagcagcagcaccaggcagacctggagctcatcgagagtgcacacagaagccgcatcaaggtgctagaaacatcgtaccagcaacgggaggagcggctccggagagagaacgaagagctgtcagctcggtatctgtcgcagtgccaggaggccgaacaggcccgtgctgagcttacggcccagcaccagcggcgcttggcggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcaacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagtaaggagcgggccgagcgcgaggccgagcgggcattgcaggtggacacccagcgggagggcaccctcatcagcctggccaaggtagggcccagagcctccggacagtggagggcccagggttgcctgcgcccctccatctggacacatccgcttccagtcttaggaaaggagagtgtagcactaatgtcacaagagcatagggattaaaacagtaatcgcatcatcatgctaacatcttcctcgtattgtcccaggtgcattatacacattttatttgatcctcatgttcccatgactttggtcatttagaaatgaggaaaccgaacttcagagttgagcctgccacagtcacgtggcttgtgagggcagcactccggcttggccccaggcttctctggctctccctggaagcccctggctccaccacctcctcccaggggcagggtgggcagaggggaccctagagtcctgcacagagtgcagcgcaattcctgggaggagaatgcagcagggcctccgctgtctccaggagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtgctgctcgggcacatgggcgt

SEQ ID NO: 433260 - DNA, 648 bp, Homo sapiens
tagcgatccccggtttataccaccatcctcaatcacccaggcctaacgcaatcctcccacctgtagctgggactacagctcacagcacacctggctaaaattttttttttgttgagacggattctctatgtgcccaggctggtctcaggctcctgggctcagatggtcctcctgcctcagcttccaaaggcacaggccaagtgttggcagctgagtatggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcaccctacaataagggagggtctggcggtgtcaaaaaacaagaacacaccataggacaaacagaacgcacaatcgacgacactcca

SEQ ID NO: 433261 - DNA, 917 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433262 - DNA, 1010 bp, Homo sapiens
acccagttctgcttcttgaaagcttcacttcctcatctaggaagtgagtctcaggaagtcacagagatgggggtcgtgcgggcagaacccacggcatgaagatccaaaagggcctggttcagctttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433263 - DNA, 1220 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433264 - DNA, 977 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaaacaacatcaaaacactcaataacatcaaccagataaaagagggggcgcaccaaaaaattc

SEQ ID NO: 433265 - DNA, 2453 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaagtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttttctggaatgtgttggtggattacttaagagttatggggaaagagttcttacggcctgtctaggtcagtgaagtcatactggcaagtgacaagaaggaagccaggtttgtcacttaccctgcatgctaaggacatcagagcccacatagaagtctggtagtttttcagccagcagtgggtagggaagcgtggataggggatttctgaacaggactttatgcctgtatgcatgggcaccatgtctgtcctgagcactaccacatggcatcgtaggctgctctgtcaaaggatatagcgatagctggtcctatgggcagatgcctagaatcaaggtgggcctcagaaatagggctgggtctccataaggaggtaggccacgttcagtccacccctagcatagatggaactggggtctcgggcaaccaggagttacaggaattttgctaaagattcccaccttccttgagtggggacacattcctctggttggagcttgttcccctaaatgaaaaatgtaatgcagtacatgtaggggccctactgtattctttttctgggggaaagctcttggtgttcacaatggctcaggcttacagtacctccagccatgtgcccatttccacaagtctttggggaaggccatgagctgagctgagagggttctctggggcctgggatgacttaagaaccaaatggcagataatgggatagggggcagatgcagaggaccaacgggaagttttaacacaaatccccttccccagatgatatggtttgcctttctgtaggtgggtggcccaggccaatttttggcaatatccttaacccacctgataggagaagcgccctcccctgcctgccttgcccattcta

SEQ ID NO: 433266 - DNA, 1350 bp, Homo sapiens
  misc_feature (19)..(19): n is a, c, g, or t
  misc_feature (1017)..(1017): n is a, c, g, or t
  misc_feature (1019)..(1019): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaagtcaattcttgaaaatgtgtatttgaagaaaaagtaaaaaaaataaaaaaacaaaaaaaaaataaataaaaaatacaaaaaaaaaaaaaaaaaaaaaaananaaaaaaaaaaagaaaaaaagataaaaactggactaactgaaaaaaaaaaacttgggggggggcccggtccccaaatctcccttaagggggtcccttttaaatttcatgtgcccagttttaaaaccttaggattgggaaaaccctgggtttacccaatttaattcccttggaagaaaatccccttttcacaagtggcgtaatacccaaaaaggccccaccattcccctttcaaaaattgccaccctaaaggccaatggcaatttgaacctaaattttggtaaaattccgtaaattttggaaaacgactttttttaaccataggccaaatggg

SEQ ID NO: 433267 - DNA, 1478 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaacaaaaaaaacaaacacaaacacaaaaaacaaaacaaaacaaaacaaaacaaacacacaaaacccaccgtcgagcgccgtctctgttgcttgcgggcggcgcacaaaaacgagggagtcagagaacggccaccacccgagtcacttacaagtacatcgtccagcacacaacagcacttgatgtcagtcacaccgcagggccaaccaccatgcggctgagccacacctcaactaatgagtcgtggcttgactgttatagctagattagtgcgctaaacaacacgcgccgccgaggtggtctaaccacacgtcgagcataatagatgaagccgcttcggccggccagcagacaccaccacgcccgcacgcacccacatgtctgctaccgccaccgacgacgatcaacagccactgctactagccgcctcacgcgtcacaacgcacacagagagcgctagactcacatgcgctacccgacgcatcccagctctcacgcacgcagcgtgacgaaggccgagcgcaacccagccacccccacacgacacgcgcacgcacgtcagaac

SEQ ID NO: 433268 - DNA, 1220 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaacaacaaaacacacctacccacagaagttactacacgaaaatcaacaaaaaaaacaggcgggggccccacaaaatacccgaggggaccagtagtctaccactttttggcaaagggctcagagggggtataaaaacggcaggccggcaaaaacgcggagggaacacacctggttccgggggacccttctgcggctatggaaccgcacagaaaagccgataaattagttttgaacctttcgcggtgtgttattaacatcagctgataagaaggaggtccgtgtatgtcgataagaaaacttactta

SEQ ID NO: 433269 - DNA, 940 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaattgggagcttgggtacccgaagc

SEQ ID NO: 433270 - DNA, 945 bp, Homo sapiens
  misc_feature (19)..(19): n is a, c, g, or t
  misc_feature (919)..(919): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaatnggagcttggtaacctctagagtcacc

SEQ ID NO: 433271 - DNA, 1274 bp, Homo sapiens
  misc_feature (19)..(19): n is a, c, g, or t
  misc_feature (941)..(941): n is a, c, g, or t
  misc_feature (943)..(943): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaaaaaaaaaaaaaaaaaaaaaaaaananaaaaaaaaaaagaaaaaaagataaaaactggactaactgaaaaaaaaaaacttgggggggggcccggtccccaaatctcccttaagggggtcccttttaaatttcatgtgcccagttttaaaaccttaggattgggaaaaccctgggtttacccaatttaattcccttggaagaaaatccccttttcacaagtggcgtaatacccaaaaaggccccaccattcccctttcaaaaattgccaccctaaaggccaatggcaatttgaacctaaattttggtaaaattccgtaaattttggaaaacgactttttttaaccataggccaaatggg

SEQ ID NO: 433272 - DNA, 972 bp, Homo sapiens
  misc_feature (19)..(19): n is a, c, g, or t
  misc_feature (892)..(892): n is a, c, g, or t
  misc_feature (894)..(894): n is a, c, g, or t
  misc_feature (896)..(896): n is a, c, g, or t
  misc_feature (914)..(914): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgacacagcgtacctgaactatttcacaaaggtgttcggntntngaaaacaaaacaaaaaanggggtataatctagggcgattgcactttaaggcatagtgttaacagcgacgcacggat

SEQ ID NO: 433273 - DNA, 860 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggtcagaacataaggtttatcctctagattcagctctgaccatg

SEQ ID NO: 433274 - DNA, 1396 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433275 - DNA, 1392 bp, Homo sapiens
ggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaatcaagctggcccaaggtgtcctgcaggctgtaatgcagtttaatcagagtgccattttttttttggttcaaatgattttaattatgggaatgcacaatttttttaatatgcaaataaaaagtttaaaaacttaaaaaaaacccacgcgtccgcgtgttatggagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433276 - DNA, 1339 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggtgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433277 - DNA, 1264 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433278 - DNA, 1163 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433279 - DNA, 1509 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433280 - DNA, 1990 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433281 - DNA, 1724 bp, Homo sapiens
tccccctccttttgtgaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433282 - DNA, 1339 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433283 - DNA, 2227 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433284 - DNA, 974 bp, Homo sapiens
tgtctccaaccggcaggtcgtactccaccggcaggttgtactccaccggcaggttgtactccaccggcaggttgtactactgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433285 - DNA, 1470 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433286 - DNA, 946 bp, Homo sapiens
tagcgatccccggtttataccaccatcctcaatcacccaggcctaacgcaatcctcccacctgtagctgggactacagctcacagcacacctggctaaaattttttttttgttgagacggattctctatgtgcccaggctggtctcaggctcctgggctcagatggtcctcctgcctcagcttccaaaggcacaggccaagtgttggcagctgagtatggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433287 - DNA, 1207 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggattgcgtacccactgcagagtgctgaagacggggtagccacgaggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433288 - DNA, 1633 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433289 - DNA, 2304 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctaatgttttttcatgcagttaccatgaactaatactacaataaaggatggtcttgggtgtcaagtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttttctggaatgtgttggtggattacttaagagttatggggaaagagttcttacggcctgtctaggtcagtgaagtcatactggcaagtgacaagaaggaagccaggtttgtcacttaccctgcatgctaaggacatcagagcccacatagaagtctggtagtttttcagccagcagtgggtagggaagcgtggataggggatttctgaacaggactttatgcctgtatgcatgggcaccatgtctgtcctgagcactaccacatggcatcgtaggctgctctgtcaaaggatatagcgatagctggtcctatgggcagatgcctagaatcaaggtgggcctcagaaatagggctgggtctccataaggaggtaggccacgttcagtccacccctagcatagatggaactggggtctcgggcaaccaggagttacaggaattttgctaaagattcccaccttccttgagtggggacacattcctctggttggagcttgttcccctaaatgaaaaatgtaatgcagtacatgtaggggccctactgtattctttttctgggggaaagctcttggtgttcacaatggctcaggcttacagtacctccagccatgtgcccatttccacaagtctttggggaaggccatgagctgagctgagagggttctctggggcctgggatgacttaagaaccaaatggcagataatgggatagggggcagatgcagaggaccaacgggaagttttaacacaaatccccttccccagatgatatggtttgcctttctgtaggtgggtggcccaggccaatttttggcaatatccttaacccacctgataggagaagcgccctcccctgcctgccttgcccattcta

SEQ ID NO: 433290 - DNA, 1282 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggtgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433291 - DNA, 1457 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433292 - DNA, 1456 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaaacaacatcaaaacactcaataacatcaaccagataaaagagggggcgcaccaaaaaattc

SEQ ID NO: 433293 - DNA, 701 bp, Homo sapiens
acctggccctagatgccaaactgatggcagcagcatctcaggcctagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433294 - DNA, 1163 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaa

SEQ ID NO: 433295 - DNA, 935 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctgtacgcccaaacatcggatccgcactgactcgagtcgacatcgccccgtatgcccacacatcggatccgcactgactcgagtcgacatcgattttttttttttttttttaacgtattcacaagtcttgtgactgtcatctggccatgggttgggcctatcattttcaggaacaaagccatgggactagaatctgagtcacagtaagtcagcatctcatgcaaagtgact

SEQ ID NO: 433296 - DNA, 1466 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaacaacaaaacacacctacccacagaagttactacacgaaaatcaacaaaaaaaacaggcgggggccccacaaaatacccgaggggaccagtagtctaccactttttggcaaagggctcagagggggtataaaaacggcaggccggcaaaaacgcggagggaacacacctggttccgggggacccttctgcggctatggaaccgcacagaaaagccgataaattagttttgaacctttcgcggtgtgttattaacatcagctgataagaaggaggtccgtgtatgtcgataagaaaacttactta

SEQ ID NO: 433297 - DNA, 657 bp, Homo sapiens
  misc_feature (19)..(19): n is a, c, g, or t
  misc_feature (499)..(499): n is a, c, g, or t
  misc_feature (513)..(513): n is a, c, g, or t
  misc_feature (594)..(594): n is a, c, g, or t
  misc_feature (642)..(642): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttgttcaanaattgacacccaanaccatcctttattgtagtattagttcatggtaactgcatgaaaaaacatttcaggaggaatttacaatttccagcttaaanaacttgcccaccaacataaccaatttatgaaagtccattcattaaaangtataaaaacctctt

SEQ ID NO: 433298 - DNA, 539 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttgttttttttttttttttttttttttttttattatatttttttatttt

SEQ ID NO: 433299 - DNA, 769 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggggagatgggagtctcgctttttgggcccgggccaagatcgtggcaggggggctttctcgggctcatgtggcaagctccggttcccggggtgtcccaccgcaatttctcggtgcctcagcggtgttctaaacatttttaaatataagatttacacctctggctcgtagaaattggcccggggtattataactcgtgctataatgccccataaggtggaatttcatccctttcatgagaaggcaaagaagttggaggtggcatagaggcccatttga

SEQ ID NO: 433300 - DNA, 556 bp, Homo sapiens
  misc_feature (19)..(19): n is a, c, g, or t
atccttaattaaattaatncttcccccccgcttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttgttttttggaaggtatatatacggcgtgtgtggtgtggaggtgttttataaagtgccaatttaa

SEQ ID NO: 433301 - DNA, 1134 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggtgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttggagacagtcttgctgtattgcccaggctggagtgtggtggcacggtcatgggtctcaaataccaggctaggaacctcccccgttgttggggataagtccaggaacccggttattaggggacgagaattatttccccgggtacaacctgggaacgccctacataggagggagagactatcgccataacaacagaggttcctagagtcagaggtgacgcgt

SEQ ID NO: 433302 - DNA, 1990 bp, Homo sapiens
ggctccccaaggaggtccacgtcctaatccccagaacctgtgactatgttgggttacacagcaagggggagttaaggttgcagacagaattgaggttgctaatcagatgtccttgagatgagactacctaagatatccagctggattctatgcaatcacaagagtccttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaagtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttttctggaatgtgttggtggattacttaagagttatggggaaagagttcttacggcctgtctaggtcagtgaagtcatactggcaagtgacaagaaggaagccaggtttgtcacttaccctgcatgctaaggacatcagagcccacatagaagtctggtagtttttcagccagcagtgggtagggaagcgtggataggggatttctgaacaggactttatgcctgtatgcatgggcaccatgtctgtcctgagcactaccacatggcatcgtaggctgctctgtcaaaggatatagcgatagctggtcctatgggcagatgcctagaatcaaggtgggcctcagaaatagggctgggtctccataaggaggtaggccacgttcagtccacccctagcatagatggaactggggtctcgggcaaccaggagttacaggaattttgctaaagattcccaccttccttgagtggggacacattcctctggttggagcttgttcccctaaatgaaaaatgtaatgcagtacatgtaggggccctactgtattctttttctgggggaaagctcttggtgttcacaatggctcaggcttacagtacctccagccatgtgcccatttccacaagtctttggggaaggccatgagctgagctgagagggttctctggggcctgggatgacttaagaaccaaatggcagataatgggatagggggcagatgcagaggaccaacgggaagttttaacacaaatccccttccccagatgatatggtttgcctttctgtaggtgggtggcccaggccaatttttggcaatatccttaacccacctgataggagaagcgccctcccctgcctgccttgcccattcta

SEQ ID NO: 433303 - DNA, 1903 bp, Homo sapiens
  misc_feature (28)..(28): n is a, c, g, or t
  misc_feature (115)..(117): n is a, c, g, or t
  misc_feature (124)..(124): n is a, c, g, or t
  misc_feature (126)..(126): n is a, c, g, or t
gggtgactatagaggatccaagctcccnacaagaggtctataccttttaatgaattgactttcataaattggttatgttggtgggcaagttctttaagctggagtgtggtggcannntcacagntnatttcctgggctcagatggtcctcctgcctcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctgaaatgttttttcatgcagttaccatgaactaatactacaataaaggatggtcttgggtgtcaagtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttttctggaatgtgttggtggattacttaagagttatggggaaagagttcttacggcctgtctaggtcagtgaagtcatactggcaagtgacaagaaggaagccaggtttgtcacttaccctgcatgctaaggacatcagagcccacatagaagtctggtagtttttcagccagcagtgggtagggaagcgtggataggggatttctgaacaggactttatgcctgtatgcatgggcaccatgtctgtcctgagcactaccacatggcatcgtaggctgctctgtcaaaggatatagcgatagctggtcctatgggcagatgcctagaatcaaggtgggcctcagaaatagggctgggtctccataaggaggtaggccacgttcagtccacccctagcatagatggaactggggtctcgggcaaccaggagttacaggaattttgctaaagattcccaccttccttgagtggggacacattcctctggttggagcttgttcccctaaatgaaaaatgtaatgcagtacatgtaggggccctactgtattctttttctgggggaaagctcttggtgttcacaatggctcaggcttacagtacctccagccatgtgcccatttccacaagtctttggggaaggccatgagctgagctgagagggttctctggggcctgggatgacttaagaaccaaatggcagataatgggatagggggcagatgcagaggaccaacgggaagttttaacacaaatccccttccccagatgatatggtttgcctttctgtaggtgggtggcccaggccaatttttggcaatatccttaacccacctgataggagaagcgccctcccctgcctgccttgcccattcta

SEQ ID NO: 433304 - DNA, 1986 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaagcaggccctgaagaatcctgtgaccttcatctaaagtaggtcatgagacccctgagcttaaaacggagtgatcggctttggagaagtaaggagacatgacgtgcctgccctggggtggggactaaacttcgtgccactccacgtgaaagggggagaaatccctggaaggcacgcaggctggacatcatcatatattctctacagatggagacaccaaggcccacgccttctgtgctgttggaatttcaggaaggatgggggtggggcacggcctcagccctgggcatgttctgcagattgcactgctcttatctgccagggggtggtgagagggtggctgagctggacagatggcgggcagggacgggctctgcggtctggcagctgacattgatacaagcaaataaagagtctttgctggggaaacaaaaaaaaggggcgccttaaatatccctagggcccagtaacgctccccctttctgccaggggccttggagcttttacaaccgcgccctaacacatacgggaacgcggagt

SEQ ID NO: 433305 - DNA, 1916 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaagcaggccctgaagaatcctgtgaccttcatctaaagtaggtcatgagacccctgagcttaaaacggagtgatcggctttggagaaaaatccctggaaggcacgcaggctggacatcatcatatattctctacagatggagacaccaaggcccacgccttctgtgctgttggaatttcaggaaggatgggggtggggcacggcctcagccctgggcatgttctgcagattgcactgctcttatctgccagggggtggtgagagggtggctgagctggacagatggcgggcagggacgggctctgcggtctggcagctgacattgatacaagcaaataaagagtctttgctggggaaacaaaaaaaaggggcgccttaaatatccctagggcccagtaacgctccccctttctgccaggggccttggagcttttacaaccgcgccctaacacatacgggaacgcggagt

SEQ ID NO: 433306 - DNA, 1303 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttgtgggagaacaagctcttgtgcgtgtttgtgcccgaggctgtgggagtgtggtgggggccacataattccacggcctcatatgggctctccctcaaactccacccgaggccttagagcaaaactcctctcccaaccttgtgttagctgtgggacaattcacgagctctccacagggcaaacacacctgtggcttaaagtattttttttgtgtgggtgtgaagacagaggagtattcctctattttgttgtgcccccggggcgtggggctctctcagaggcgccgcgggggcctcagaagagtggcgcctctcgtgggccctcaagttctccaaaagaggggcaaaggcgcccaagagttgggtaagttgtgtgcgcccccttgtgcgcattttagtgacccccaaacagagagagaggggctctatattcacgctttttatagcgtggaaaattgggggactttctcaaataaactgtgcggggataagtgtggtgggggcggggggcaagagtcctctttaaaaaggcgcgttgacaccatttgtgcgcacaatgttgccttca

SEQ ID NO: 433307 - DNA, 1265 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgagccgatgcagcctcagtgttcctttgccttgggggtttctgagtggtggggttgtaagcagatcctgccaggcacccagaaggaaacctcatcaggactccctcagaaagcaggccctgaagaatcctgtgaccttcatctaaagtaggtcatgagacccctgagcttaaaacggagtgatcggctttggagaaaaatccctggaaggcacgcaggctggacatcatcatatattctctacagatggagacaccaaggcccacgccttctgtgctgttggaatttcaggaaggatgggggtggggcacggcctcagccctgggcatgttctgcagattgcactgctcttatctgccagggggtggtgagagggtggctgagctggacagatggcgggcagggacgggctctgcggtctggcagctgacattgatacaagcaaataaagagtctttgctggggaaacaaaaaaaaggggcgccttaaatatccctagggcccagtaacgctccccctttctgccaggggccttggagcttttacaaccgcgccctaacacatacgggaacgcggagt

SEQ ID NO: 433308 - DNA, 1409 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaagcaggccctgaagaatcctgtgaccttcatctaaagtaggtcatgagacccctgagcttaaaacggagtgatcggctttggagaagtaaggagacatgacgtgcctgccctggggtggggactaaacttcgtgccactccacgtgaaagggggaggcatgactccacagtttctgcaacaacagagccggggaaaggaggacgcagcaagcgctgaatattaaccagcaaaggtagatgcttcaatatcgaaaccaccgggacccgcatgtgcaaagctacttaatgagggtgtaatcaaacacagtctaccagaaggaaattaattagagtccggagagcaagcaggaagcagaaccaggctgctccccctcctggctctagaacatcactggcagccactgctaagggagggacaaggctgggggatgccaggcctcagctggtgtgccagggctcctgtcctcttccccgtgacattccggcttgcctttgggggacacccaggggagggaagggaaatgtcaggtgctgttagggaaacacagcctgaggaagcccccagggagagaagctgggacatcccagagttaaggagctgggcacagagaagacttgcttctctaggaagacaatggtctcataagaagaaggacggaatcataaacaacagaaatgtattctctcatagttttggagaccagaaatctgaaatcagggtgttggcagag

SEQ ID NO: 433309 - DNA, 1159 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgagccgatgcagcctcagtgttcctttgccttgggggtttctgagtggtggggttgtaagcagatcctgccaggcacccagaaggaaacctcatcaggactccctcagaaagcaggccctgaagaatcctgtgaccttcatctaaagtaggtcatgagacccctgagcttaaaacggagtgatcggctttggagaagtaaggagacatgacgtgcctgccctggggtggggactaaacttcgtgccactccacgtgaaagggggagaaatccctggaaggcacgcaggctggacatcatcatatattctctacagatggagacaccaaggcccacgccttctgtgctgttggaatttcaggaaggatgggggtggggcacggcctcagccctgggcatgttctgcagattgcactgctcttatctgccagggggtggtgagagggtggctgagctggacagatggcgggcagggacgggctctgcggtctggcagctgacattgatacaagcaaataaagagtctttgctggggaaacaaaaaaaaggggcgccttaaatatccctagggcccagtaacgctccccctttctgccaggggccttggagcttttacaaccgcgccctaacacatacgggaacgcggagt

SEQ ID NO: 433310 - DNA, 1146 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggcatgactccacagtttctgcaacaacagagccggggaaaggaggacgcagcaagcgctgaatattaaccagcaaaggtagatgcttcaatatcgaaaccaccgggacccgcatgtgcaaagctacttaatgagggtgtaatcaaacacagtctaccagaaggaaattaattagagtccggagagcaagcaggaagcagaaccaggctgctccccctcctggctctagaacatcactggcagccactgctaagggagggacaaggctgggggatgccaggcctcagctggtgtgccagggctcctgtcctcttccccgtgacattccggcttgcctttgggggacacccaggggagggaagggaaatgtcaggtgctgttagggaaacacagcctgaggaagcccccagggagagaagctgggacatcccagagttaaggagctgggcacagagaagacttgcttctctaggaagacaatggtctcataagaagaaggacggaatcataaacaacagaaatgtattctctcatagttttggagaccagaaatctgaaatcagggtgttggcagag

SEQ ID NO: 433311 - DNA, 709 bp, Homo sapiens
  misc_feature (625)..(625): n is a, c, g, or t
  misc_feature (642)..(642): n is a, c, g, or t
  misc_feature (675)..(675): n is a, c, g, or t
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaagtatattcccagaggatgtcagtcctgctggtcctaggggccctgctggtccttntggccctgctggaaaanatggtcgcactggacatcctggtacatttgganctgctgggcattcgaggccttagggtcaccaagg

SEQ ID NO: 433312 - DNA, 2419 bp, Homo sapiens
tccccctccttttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactggattgcgtacccactgcagagtgctgaagacggggtagccacgagtgcaaattcgtgaagaaccagcctgggcaacatagcaagacccctttatctataaaaataataataactaggtaccattgtgaaaaataataactagggattgattatagtatctttactctgtattcacaaatatctgtattcctggacatatttaatcctttgatttacctctgactaggtttgtcattgtaatccctgggctgcttaggaggataccatttggtttgatgaaaaagctggaatgataatagctcaaactcttttgagcatttagtacatgcttggcactgttctatatgtcttaagttattcactcttgtatttaaccatcaacactcttatgaggtaaatatcccgcaattacttttgcgccaacctagtaccactacagacaaggaaacagatgcagagaggctaagttacaagggcacacagccataaactttggatctgtggagtgactgggcttcagagtcctcttcctgactgctgttcctatgtcttttgcaaagagaagtctttgacaggtatatgctttattaaaatcatgtttagaaaaaaatgagagaatagaattagaaaaaggaatgactgtaggcttcgatgaaaatgacttttgtgactaggtgaaaattgtttggctgggtatcctggaaaattgtcttctgggaatatctatattccagggttcacttttgtcatagaattgtttcttggcccatttaagagagatactttgtttattaataaatcaaacgttttaattttagacatctgtgatcagttcttttaaagagactatatttatttaagtacttcccaagtttagtgcaggggtactacctaccatttattcaggatcatagaggataagttagggtcaaagaaaatagagactgccatgacagcggcttgcttgctttctccccaggaataatgcacaaataatttatagcagctgatatttttcggtgttaacagataataggggaatttgctgaaatttttatttggagcctcggatttaattttaggccactgggctaatttatttttaaatgtaaattaattccagtactttatttgtaaagtttacttgagatctaactgttctaagacatgctgttgcattacaaataagaattgctgcatttattttgatcccattgccagaggcaaaattagtcaaaatttaaaggtatgtagaaatacttttgtaatccttctaaactacattaaatttctggctgactggtggctcacacctgcagtctcagcactttgggaggctgaggttggcagatcaacatggtgaaagcaggtctctactaaaaaataccaaaaaaaattagccgggcatggtggcgcatgctactcaggaggctgaggcgcgagaatctcttgaacctggaaggtggagtttgcagagagccgagatggtgccactatactcaagcctgggctacagagtaagacactgtctcaaaaataaataaaattataatttcttagatttaaaaattagatttgttttccaaagacagggtagtagaatatgtagggtacttgtatagatagatatatgttacttaatgcagtactgtctggtgcagggtatcttcacgtggcataatagacccagagcttcaggtctaggctctgtaaagcgaaatgccaaactactgtgtgtgcatttctcgaaagaaaggtgatgtagttttatacaattttgaaacaagtccatgactcccaagggtttaaggaccaatggttcagtgagacatttacagattttgaagttagaattcagtttgaattctatacacatttactagctatgcaaccttggacaagttacctaacatctgtgagcctcagtttctttacctgtagaatgatatatttgccccattgggttgttagggtt

SEQ ID NO: 433313 - DNA, 762 bp, Homo sapiens
  misc_feature (694)..(694): n is a, c, g, or t
  misc_feature (707)..(707): n is a, c, g, or t
  misc_feature (744)..(744): n is a, c, g, or t
  misc_feature (746)..(746): n is a, c, g, or t
  misc_feature (756)..(756): n is a, c, g, or t
ctccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggagccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacaagcctgcccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtatcgcgccnctgcatttcagtntgggcaacaacagcgaaactctaactcaaaaaaactncnaaaaaaaaancaaaaa

SEQ ID NO: 433314 - DNA, 776 bp, Homo sapiens
ctccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggagccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacaagcctgcccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtcttgctctgttgcccaggctggggtgcagtgagctgagaccgttcattgtactccagcctaggtgacagagtgagatcctgcccccaccat

SEQ ID NO: 433315 - DNA, 2284 bp, Homo sapiens
gttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaaaaaaaaaaaaaaaaaacgcgagactagttctctctccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433316 - DNA, 1476 bp, Homo sapiens
gataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433317 - DNA, 958 bp, Homo sapiens
  misc_feature (18)..(18): n is a, c, g, or t
  misc_feature (48)..(48): n is a, c, g, or t
tccgaagagaagacggangtacggctaggtacgaggctgggtttaaantcggccgaggctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagatttt

SEQ ID NO: 433318 - DNA, 774 bp, Homo sapiens
aggctgtgtgagaccgtgcttcttgtacaggttaagggggctgggcaccatcttatgtgggctaagggcatccaggcggctacgtgcaactgtggtacctcttgcctgatctacaggcggttgggacagaccacagaagtcatcctggaaaccagagggaggcatggcctgatacaactatggttctatgaacacctgttcggtttatactccggagtataaaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcacacgtcctgtactg

SEQ ID NO: 433319 - DNA, 869 bp, Homo sapiens
gataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagatttt

SEQ ID NO: 433320 - DNA, 242 bp, Homo sapiens
gaatgcctgatcggctatatactccgagggatactctaaatcgacttgcctggcatgccctctaggcattggacgtcgtgtaagaaagtcggcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433321 - DNA, 1722 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433322 - DNA, 1746 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcagtataagtccggtgccgagtttt

SEQ ID NO: 433323 - DNA, 1748 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggttataatccgggccgagctcgatg

SEQ ID NO: 433324 - DNA, 1702 bp, Homo sapiens
gaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433325 - DNA, 1703 bp, Homo sapiens
  misc_feature (34)..(34): n is a, c, g, or t
  misc_feature (36)..(36): n is a, c, g, or t
  misc_feature (38)..(38): n is a, c, g, or t
acagaacgtactacggcttaggtacgaggctggngntntgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433326 - DNA, 1641 bp, Homo sapiens
  misc_feature (18)..(18): n is a, c, g, or t
tccgaagagaagacggangtacggctaggtacgaggctgggttggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433327 - DNA, 1557 bp, Homo sapiens
gataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433328 - DNA, 1643 bp, Homo sapiens
gagacgaggtctcactatgttgcccaggctggtctcaaactcctgaactcaagtgattctcctgcctcagcctcccaaagtgctgggattacaggcgtgagccactgcgcacagccagatggagtctttttctaagatggaattagttatgtcaagggtgacctatacatattatatagggctggggaaggttctgaagaggctggaggcctggggcaggttcaggtgccctgctgacactccctttcccgtttccaggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433329 - DNA, 1464 bp, Homo sapiens
tctgtctccacgctacttggaggctgaggtgccaggatcatttgagcctcaggagttcgatgaccaacctgggcagacatagtgagattctgtgaacaaaaccataaaataaaaatagagaaccatattccaaataaccatgaaacaaaataataactacaatatgaaaagacatacatagaagaggataacattgaatcacaaaagggagaatgatacaaaggatgcatgagaaaaatcaggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433330 - DNA, 1343 bp, Homo sapiens
cacacacacacacgctgtcctgtacctccctacacacacacacacacatgctgtccttacactggcttacctccctatacacacacacacacacacacgcacacactgtcctgtacctccctatacacacacacgctgtccttacactggcttacctgcctatacacacacacacacgcacacgctgtcctgtacctccctacacacacacacatgctgtccttacactggcttcctgtccttctcaccccttttcaggaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433331 - DNA, 1912 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 433332 - DNA, 1955 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 433333 - DNA, 1834 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 433334 - DNA, 789 bp, Homo sapiens
tgcgcggtgctctagaggatctcccgggagccttacctccgggagccttaacctccgggagccttaacctccggagccttaacctccgggaccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433335 - DNA, 560 bp, Homo sapiens
caggatgcatggtcatccctggccactgcagtagggttaaggatcagtgttgtcgcatgggttgcagctgaaacttggattcaatccctggcccagagatttccataggccaggtatgcagacattaaaaggaaaagaaaagaaatctgcacagagagagaaaccagaggaacgcaggagcctgttcggtttatactccggagtataaaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggttataatccgggccgagctcgatg

SEQ ID NO: 433336 - DNA, 1596 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttgcgcctccactgaggcacctctctgggaataacgttccccagcaccccaaatggatttccagtcaattcagaagcattttaccagtgaagccctcattattccagttcactgttaaagccagtaattctctatattaaactttccctgttc

SEQ ID NO: 433337 - DNA, 1330 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 433338 - DNA, 1257 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataagcatcctgctagatcacccactt

SEQ ID NO: 433339 - DNA, 833 bp, Homo sapiens
acaggctggtacgcccggaatgtatggataaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttc

SEQ ID NO: 433340 - DNA, 814 bp, Homo sapiens
  misc_feature (34)..(34): n is a, c, g, or t
  misc_feature (36)..(36): n is a, c, g, or t
  misc_feature (38)..(38): n is a, c, g, or t
acagaacgtactacggcttaggtacgaggctggngntntgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttc

SEQ ID NO: 433341 - DNA, 839 bp, Homo sapiens
  misc_feature (18)..(18): n is a, c, g, or t
  misc_feature (48)..(48): n is a, c, g, or t
tccgaagagaagacggangtacggctaggtacgaggctgggtttaaantcggccgaggctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttc

SEQ ID NO: 433342 - DNA, 739 bp, Homo sapiens
tgagatggagtctcgctctgtcacccaggctggagtgcagtggcacgatctcggctcactgcaagctccgcctcccaggttcaaacaattctcctgcctcagcctcccaagaagctgggagtacaggcgcctgccaccatgctcagctaatttttttgtatttttagtagagatggggtttcaccgtgtattagccaggatggtttcgatctcctgacctcgtagtccgcccacctcggctcccaaagtgctgggattacaggcgtgagccaccgcacctggccaatttttgtattttttcatagagacgaggtctcactatgttgcccaggctggtctcaaactcctgaactcaagtgattctcctgcctcagcctcccaaagtgctgggattacaggcgtgagccactgcgcacagccagatggagtctttttctaagatggaattagttatgtcaagggtgacctatacatattatatagggctggggaaggttctgaagaggctggaggcctggggcaggttcaggtgccctgctgacactccctttcccgtttccaggtttcgagacaaggagtggatcaggccagataagtatggccatttctctcaggagttctggaatttctgtgaagtgcctgtcgaagctgtggatgccggtgactgtgacatcaactacgagggcctggataacctccgtgagtgcggtggggtggagatgggacaggcctctatgtt

SEQ ID NO: 433343 - DNA, 1471 bp, Homo sapiens
attatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctctgtaggtgattgttgcagtcttccttggtttttgagtctttttaaacaagctcctaccctgcttctatccttttagagtaggagattaaaaataaacccaccccagtcaacctttagataagcactcttaaaaacaaatttgaagagcactcttcagccaagttcatttttattttgttgttgatgttttgagcatacatttaattgtaaggccttttggaaaagccctaaaagaataagatacaaccagaaatatttgagttttgttaaatgtactgaaatcttgtaatgaaaatccctttggccagaaatgagatttatttccatttatttttacatttaagtaacactcaaaacaaacaagtagtcacttaacctgccagttattattttcttgaaaatatacaagaaagtaaaaatatctctaatatataagttaaaggaaagttaagagactaagctagttttttcagtgaaagcaaagttggaaatattttgcttctctcagattattggaagacctagagctactggatgttaacctgaatcaagatgttcttttcacatttttttaaagggctagtatgttccagagtaggcaagtagtcattcaagccaaatgaaagagttaactggtccttgaggagtgttagcaaaatttaaattttgaccctggccatttgtactacagaagtgattatgggattaaaagaatacataattacagtgttttgggattgggctcttttttttcttaatagaaaagcagaaacttcataaataatagctgtgctttagataccagataacaaatattgtttcccctgaagatatgacctactagaactactcacatatatagtccaataattactgacttaataggtatggtaaaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattaaaaaaaaaa

SEQ ID NO: 433344 - DNA, 1947 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctcacgttgtctctttcctcttcggattcttgtttttttgcgtctccgtcgtcactgcagacccacgttccgttgggttctggagactcagggtctctcccccatcacgctggctcatgggacggggcgaggcccacgccgctgcacacaggaccacacgtggtggtgcgcgatgtacttcctgaaagcatttctgtgttctagttgagaagttcgagtatatttattataagatagttattggt

SEQ ID NO: 433345 - DNA, 1213 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagcgctggcgagttgggtttggaagggtcctggccgggccacgagctgggggtggtgtccgccgtcggggtgtgggggggggcctctcttggggggcccctccggggcctggcccccgggccttcgc

SEQ ID NO: 433346 - DNA, 1064 bp, Homo sapiens
  misc_feature (1017)..(1017): n is a, c, g, or t
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggaatcccttagatttcnaaccggctgtgttgggggaacagcatccggtggcggcttttgaactt

SEQ ID NO: 433347 - DNA, 1902 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctcacgttgtctctttcctcttcggattcttgtttttttgcgtctccgtcgtcactgcagacccacgttccgttgggttctggagactcagggtctctcccccatcacgctggctcatgggacggggcgaggcccacgccgctgcacacaggaccacacgtggtggtgcgcgatgtacttcctgaaagcatttctgtgttctagttgagaagttcgagtatatttattataagatagttattggt

SEQ ID NO: 433348 - DNA, 1099 bp, Homo sapiens
aattgtcagcatttttcaaaaacagctttatcgaggcaccactgacatacagtaagttgcacgcattcagtgtgtccgactggatgagttctgagctagctccacacccatgcacccctcatcagagtaagagagcaacagagtaagagtccccatcactgcaggcttccctgtgcccccaagcctcccgctgaccccatgcagcccccagcgtgcccacatcactgcagctcacgtgtcctctggagcttcctctaaaaggcggtatttgtgccgcggcacgcgctctgcgtcagctcctccctcggggttgcctgtctgtctcttccccactctaggcctgcctgggggaggaggggtccatgcacctctgtggccccagcactgggcagggcttcattgctggctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctcacgttgtctctttcctcttcggattcttgtttttttgcgtctccgtcgtcactgcagacccacgttccgttgggttctggagactcagggtctctcccccatcacgctggctcatgggacggggcgaggcccacgccgctgcacacaggaccacacgtggtggtgcgcgatgtacttcctgaaagcatttctgtgttctagttgagaagttcgagtatatttattataagatagttattggt

SEQ ID NO: 433349 - DNA, 240 bp, Homo sapiens
gggacctcaggctcctgtgactttggaaaacgaattgtgatgctcacttcctggccgaatttaaattaagagatcagaggaagaagaaaggggctacttcttatcttcctttccagatcttattgcatatgaagtcaaggctaaccagcgaaatatagaaggtgagtgtttgcatactggcccacaccagacaaaagagacggggcacagtggctcacacctataatcccagcactttgg

SEQ ID NO: 433350 - DNA, 513 bp, Homo sapiens
gcagcagctgtggcgtgagggcagagtccgtcctctcagtgtagggcacgcggctcggctcgacccttgcctggcgcggcctgaggtcctgtttgtaatttgatatcttattgccacagagtctgttctgtcagtttaaaataattcatcagcatttttctccaaaggtgattcataagaaaaaaggacgtagggaacacagtcgggctagaaagtccattgaccactcagggccattggcggctgaggccagtgggcctgtggggggcgcttaccgtccaggtcccctgacccacggccgaccctcccgcccccagatggagccagtcaccatcccagatgtccacggcggatccttgcagaatgctgtccgcgtgtggagcaacatcccagccataaggaggtatttcctgggcagctgaaagcgttcagggtcaaggggaacatggacccagaagcggggttcactgaggaaatggggtctgtctagcagagccaagcccagagcagcct

SEQ ID NO: 433351 - DNA, 7593 bp, Homo sapiens
  misc_feature (101)..(101): n is a, c, g, or t
atctaccaccttaaaaccctgatctagaaaaaatatatattcatgataggaagttataactaagaaaatttatttgcctcttaatgctcctgaatgaaagnaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433352 - DNA, 2098 bp, Homo sapiens
  misc_feature (1)..(1): n is a, c, g, or t
  misc_feature (1250)..(1250): n is a, c, g, or t
ncccagagccaaattttacttaaaacagcccaaaagaaggcccaatacattgagatcatgtttccacatttaaagagcaactcctaaaataactgatgtcctatattacactctgcagtggtcaaaattttaaatattgttttccatatccagaagttagtatcaaataaatcataggtgtgatgttatacacacctctataacttctgtaatgaggtgaaattacactaaagctagtaaattggtcatatacttctctacatataaagagcccgatatgtgctacaagattacttcttaagtacagaagaatacaactccattagaaatttgacttaaaaataatatgcctactataatgaacattgctaattgcttatattttaggagactgggggagggtgattgatagtgatttagatgattgcctttagattctattgtcctgtagcaagtagatatttattttttctgaccaatggattcacatgactttttttttctttttctaagcaagcagatatttagaatcattctgttaacttcacagctttgcttaaagctggggaggcctggccaggcacagtggctcacgcctgtaatcccagcactttgggaggccaaggcgggcagatcacgaggtcaagagattgagaccatcctggccaacatggtgaaaccccgtctctactaaaaatacaacaacagttagctgggcgtggtggtgtgcgcaggtagtcccagctactcgggaggctgaggcaggagaatcgcttgaacccgggagacggaggttgcagtgagccgagattgcgccactgcactccagcctagcgacagagcgagactccgtctcaaaacaaaagctagggaggcttctcttatagtcattggtgcatctatgtgaattgacatcccatgttatgacctcctttacaatggtcttttcaagaaagagcacttgtaaaagaaaagaagagctcataagaaaagaagtttagagtttaggaccaggcacagtggctcatgcctgtaatcccagcactgtgggaggccgaggtgtgtggatcacttgaggtcaggagttcgagaccagcctggccaacatggtgaaaccccatctctaccaaaaaatataaaaattcctgtagtcccagctactcaggaggctgaggcaggagaattgcttgaactttggaggcagcagtccagccagacaagagggagagagagcaaaaagaaagttagtntagtattgtttccactttttaggtaacatatttcatatttgttctaaaatgatcccttttaaagtttcaataatctacagatttttaaagaacatattcatctatctgaagtagtagttagctgaaggaattccaccttttcttaaagttgaacagtttatttgatgtgatcttttttaaaaaaacaaactttctaaagaatgtgaaatatttatttccaaggcagaaataacctaatgttctacttcctagaaacatcatgttctaacattgtgagtacagaggaaacagtctcttccccaaacctagccactagagctgtggctggaaaactctgaacccttggtataccgcaagtgtttctgtttcttcattttcagtatactaataagcctctgtatacaacattacaggtgaagatctgtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433353 - DNA, 1997 bp, Homo sapiens
  misc_feature (406)..(406): n is a, c, g, or t
  misc_feature (504)..(504): n is a, c, g, or t
  misc_feature (1589)..(1589): n is a, c, g, or t
ttaatagatccctgctgttacttacaggatgctacacagagttgccttagaagcagtagctactgtgaacaattgcctgccccttgagtgtgttgttgctgctcagagcatcctaatatgtatggtgttctgagtcccatgggctccctatctttagatttcagccactcaaggggatggcagcccaactattttaggagctccctggggcccttcaaagggaatttcatgcatgtcacacacaccctgtatttcaagtccgactgtcccaagcatcaaactagttgaaaacctacctggcaataatggacaaatacaacttgattttacttagattgataccctgcccctctcccttccaggatgtccaaggccctaatttgcaaagtaagtctaaatgaatttncctacagtggtagttctgcaatttaacctctgtaaatgggatgggaagtttttgttccccagttgatgtattaaagcatgtcactggaactcagcagngatgtgaccaggacaacgggggacatgatgaaattcctgacagagaatcttgtgagttagaaaacagtcacttgggtggccagatcattattcttctgtggccgtctgtgctcttccacctcttggaattttctgggagacattaatatatttacttccccattgcttgatgcttcctattgtgttcaccatgtggctctttcacaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgagggtagagtgttatttgtttattaagcattaaacccatcttccaggaccgctgtatggtgaacatcaccataaaacacttaaggttgtttgggttgaggacaaagtcaggtataaaatagaagatacaagggcttaccacatacctccatggtgccatgctagtgccaggaacaccagggaaaagacaaggtccgcagaaggacatagacatgtaaacaaacacagtgcgagctaaaaagagacatcgttgagtcacccacaaagtgctgtgggggcagagagaaggaaaatagagagctgaggggcaggcacagagggctccacagagcaactgacacgcaggtcttgaagaacgtgtaggattttaccaagcaaagaacataggagaaagtatccccagcagaggagacagcatagaggcataaaagacagcttgttcaaggaagcacatgctgttctggatggctagagcatgagcactctgtgggcaaggaagggctagaagagaacagagatcacagaggccccaaatactgtgtgtagaacacaatgtaaagtatattagcactgtgtattataaactatataatatgaaatatcactatgaagtgataatatatttgcttcatggctatttgtttgtttgtgttgctataaagaaatacttgaggctgggtaatttataaagaaagaagnttaattgactcacagttctgcaggtgtacaggaagcatggtgccagcatctgcttctggtgacagcctccggaagcttacagtcatggcagaaggtgaagcgggagccagcgcatgacatggcaagagcaggagttcgagaccagcctggccaacatggcaaaatcccgcctctactaaaaatacaaaaaattagtcatgcacctataatcccagctactcatgaggctgaggcaggagaatcgcttgagcctgggagatggaggttgcagtgagccaagataatgccactgcactccagcctgggtgacagagcaagactgtctcaaaaaaacaaacaaacaaacaaaaaatacccgcctcctgtgtactccacagggcacagggagctttcagtgtactcagctgg

SEQ ID NO: 433354 - DNA, 490 bp, Homo sapiens
  misc_feature (51)..(51): n is a, c, g, or t
  misc_feature (62)..(62): n is a, c, g, or t
atagtcgaagtcgcatctttgagattataggttgtgaagcaggaaaacagnagcttgagtgnaacgtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433355 - DNA, 485 bp, Homo sapiens
agaaaaatgaaaagcgataacaaatagagaaaaaacgcgagtacgtgaacatttaacagagtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433356 - DNA, 557 bp, Homo sapiens
  misc_feature (56)..(56): n is a, c, g, or t
ttagtcagcaggccgaatatacaaataaaaccaccccggttgcgggcaacactttnagaaagtttgtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaacaaaaaaaaaaaatgggcctcgttgacctaagagaagaagctttgccggccgattacctgttaagac

SEQ ID NO: 433357 - DNA, 6434 bp, Homo sapiens
  misc_feature (206)..(206): n is a, c, g, or t
atggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggcncttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433358 - DNA, 6877 bp, Homo sapiens
  misc_feature (206)..(206): n is a, c, g, or t
atggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggcncttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaattggaatttcatatatttttcacatgtcacaaatactcttgttttgactttttttcaaccatttaaaaacttaaaaactattcttaattcaggggccatacaaaaacaggtggcaggctagatttggcccaaggaccttaatttgccaacacaactaagagaagagaactgggaacaaggagcacaaagatctgaaaacaggaaaggaagtttagccatacattttatggccgagaattagaagcttagaattagaagctttggggcatttcaagtgtaaatatgtcctataacataagagtcattaaaattcaatttagttcctgtattgtgtaccacagtgcactcctctttaggatttttttacatatagaaataatattgggttttttttaaggttattgcctattcagttaatagggttgctttaaaaaaggttattg

SEQ ID NO: 433359 - DNA, 4304 bp, Homo sapiens
cattaatatttaaaagctcttctctgttttcatctaaggactggttaagaaaggaatcagacaatacactcaaaggtttcttcttaaatgtaattctataacttagaatatagaaaagaacgtgcattatttcccatagattaagagtgagtaatttggggctctttttaatagacatcttcagaaacactgagttattttgcccattgatctgcaatttcaaagaactgatttgattaatagaggaatattaacctcagccctgggcccttattaaatagactagaaacatgttttctttttcacatagaacatgttttatttcctctgatacaatataggttaagagatgtgaaaagagagtactggaaaatagcttcaatcttaaataacttgcactcatccttttgctcatattgctaattgggagcaagtctggtgggacagaatcacaacagtggcctgcccttgtgcccatgaaggccttgtctttgttgcagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433360 - DNA, 1407 bp, Homo sapiens
tacaacacatcataaactcacgaccacacttacctacacgtcgagattcagtatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433361 - DNA, 1415 bp, Homo sapiens
acatgctgcgaaatcgacttaataagcatacgtgacaataaccctgcgcgcggttctactatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433362 - DNA, 1412 bp, Homo sapiens
aaaaccacgatccaatagtattctataccgtcacctcccaccccactagttatacacatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433363 - DNA, 1411 bp, Homo sapiens
ccccagcacataagaatgtccgtgaacaaaacatcaaaaacgcctgtagttatacaatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 433364 - DNA, 2684 bp, Homo sapiens
  misc_feature (101)..(101): n is a, c, g, or t
atctaccaccttaaaaccctgatctagaaaaaatatatattcatgataggaagttataactaagaaaatttatttgcctcttaatgctcctgaatgaaagnaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtaagttttacacgttaaaagtgaggaat

SEQ ID NO: 433365 - DNA, 443 bp, Homo sapiens
cattaatatttaaaagctcttctctgttttcatctaaggactggttaagaaaggaatcagacaatacactcaaaggtttcttcttaaatgtaattctataacttagaatatagaaaagaacgtgcattatttcccatagattaagagtgagtaatttggggctctttttaatagacatcttcagaaacactgagttattttgcccattgatctgcaatttcaaagaactgatttgattaatagaggaatattaacctcagccctgggcccttattaaatagactagaaacatgttttctttttcacatagaacatgttttatttcctctgatacaatataggttaagagatgtgaaaagagagtactggaaaatagcttcaatcttaaataacttgcactcatccttttgctcatattgctaattgggagcaagtctggtggg

SEQ ID NO: 433366 - DNA, 463 bp, Homo sapiens
tcagatttttgctagatttgtctttctttattctgcataaacctattatttactcacattttttctttttaaacatagaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcaggtaaaagcctctcccttcctcacctgagtcctttcctcagcataaattattggaacaaatgtctgtgcactgatggctcattttatgagtgaagttcctcaacaacagggacctcaaaggggagtgtgtgcctcttaaggctgggaaattgcctcacatggtggctcatgcctgtaatcccagttttaggaagctgaggcaggaggattacttgagcacaggagtt

SEQ ID NO: 433367 - DNA, 440 bp, Homo sapiens
gcggcatgaagggatttcagagcttcatggtttcagatagcaacatgagttttgttgaatttgttgagctgttcaaatcattcaggtacagtcttatgtttccttcttattctttctcaggcccccccatttctataaagatactcaatgagaggtgttttccattcctcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctaggtttgttgaacattttaggatttccctttgggatcaatctgtctaaaacttaaggtcagaggtccagtcacacaaactctgagcctgtcccacatagtgtgctattactgctgtgtagggaaagact

SEQ ID NO: 433368 - DNA, 6955 bp, Homo sapiens
  misc_feature (6898)..(6898): n is a, c, g, or t
  misc_feature (6950)..(6951): n is a, c, g, or t
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagcccagcggatttctgggggaggccctggcagcggctcctgtctctctgacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcaggcctaatccccttagtaagggtaaatttagctnggcatgtccatggtaatcatcccaacctcccacgcctcccttccttgatttnnatat

SEQ ID NO: 433369 - DNA, 6685 bp, Homo sapiens
  misc_feature (6628)..(6628): n is a, c, g, or t
  misc_feature (6680)..(6681): n is a, c, g, or t
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaactggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccaccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcaggcctaatccccttagtaagggtaaatttagctnggcatgtccatggtaatcatcccaacctcccacgcctcccttccttgatttnnatat

SEQ ID NO: 433370 - DNA, 6610 bp, Homo sapiens
  misc_feature (6553)..(6553): n is a, c, g, or t
  misc_feature (6605)..(6606): n is a, c, g, or t
gggacccagccagtagcttctgctatgtgtgtctgagtaaccattgctggtgcaggggtatatggactcccaatcagaacacttcctgaactggttagtctctgtggtgtgcttataatcatttggggtccaacattcacatttattggtcctaaggtttttggtaaaatctttgtaggtgagttggtattggaaactggaaatgcaacaaatgaaatgttgccttttgttggactgagattctgatctataaatcctcttacttctgcatttgtggaagtcaaaccaacattttttgccgtcatgtcaaactgtattctatttaagattctgtaaagccattaaaaaaataaaaagaaaaaaaccttcgtcttcaataattctttaaaagaacaaccgccttcggctgcagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcaggcctaatccccttagtaagggtaaatttagctnggcatgtccatggtaatcatcccaacctcccacgcctcccttccttgatttnnatat

SEQ ID NO: 433371 - DNA, 6281 bp, Homo sapiens
  misc_feature (6224)..(6224): n is a, c, g, or t
  misc_feature (6276)..(6277): n is a, c, g, or t
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccaggctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcaggcctaatccccttagtaagggtaaatttagctnggcatgtccatggtaatcatcccaacctcccacgcctcccttccttgatttnnatat

SEQ ID NO: 433372 - DNA, 420 bp, Homo sapiens
ctggcccctcccccagtcatgacagctggaatgtccccagacattgccagcatacccaggggacagagtcgcccggcgggcatgcctggtccgacacatggatgcgagcgatggagccagggctaagcagtgccttttgtccccaccccatcccccagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctcccca

SEQ ID NO: 433373 - DNA, 615 bp, Homo sapiens
ggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcagcgggcgggggcaggcggctcagggcacactcggccgtccctgccccatcctctggcagggctgcttttgtctttgtacctttgcatcctttgtaatgaaacgtaataaaaatccaacgttttcgtcactggctctt

SEQ ID NO: 433374 - DNA, 439 bp, Homo sapiens
caggaaaggccggcaggaaacgccccccgccctactggtcccagctgtttgcaggcctcaggccgaccccagccagccagccggggcttcctgccctgggctgagagtgtgttgttggaggcggggtctcagccagtggcactgcccccttaactcacctcacgccgacagctgcccctatggcaccatgtacctctcaccacccgcggacaccagctggagaaggtcagtggctggacaccccccccccgcccccttcttgttggaaacaaaaccaaactctcatcatggttacatgtggaaaagcaggacacagtcgcttaaacaatgaccaaactaagatgcatccagaagtttctagaaattagccttcaccctgaaacacaggagttccagctttgggaggtcttctaacatttcccttccccccacttatgac

SEQ ID NO: 433375 - DNA, 412 bp, Homo sapiens
  misc_feature (1)..(1): n is a, c, g, or t
  misc_feature (5)..(5): n is a, c, g, or t
ntagngaatctcttgtactacctgaaaaggtgactgccgagaaaggacaaatgtcttccctcctccagcgttctgagaggactgccttgccttccttcgttactggaacatgacaacctggctcatgggtgtactcccagtgctttgggaggccaagatgagaggattgaggacaggagttcaagactagcctggacaacatagtgagaccccatcaaaaaataaaaaaaaaataaaaaaataaaaaaataaaaaacaagtaaaataaataaaaaataaaaataattatataaaaaatattagctgggcgtggtggtgcatgcccatagtctcagcctcccgagtagttggaactataggcacacgctaccctgaccagctaatttttgtatttttagtggagaccccatca

SEQ ID NO: 433376 - DNA, 1009 bp, Homo sapiens
cctgggataaataagtgttcacatttttcagttttgctcctcttttaaaatatactaaacaatcataacagacctaaggttatttttttctcatccccagtctcatttccctttcctaagaagcagcttcaatcatgattttggtgtgtatcttgtccttccatgattttataatttcctcttgtatatgtttgcatccatatacaaaatgtagtattttatgtgttttagaatttttattcaatgctgtgttttggagatctattcatattgctacacaaggacctagtttattcattttaacagttgaaaagtatttcatcataggatttataccacagttcagttacctattccccccagtaatggatatatagtatatttccaggtttttgttataccaaatcgtgctgccaagaatttacgtgcaagtgtttcctggtgctcatggttagagcttttccagggtagatcattaggaagtggaattgttggtttgaattgttacatagcttcaacttttccagattctgacgaattagtataaaggtggctgtgccaatttatacttatatgtctgagtgtcccagtttcctcattttctggccaattaatgcttggtgttatcagacttttttggcttatgccagtcggaaggctttgaaatagtcattatttgaattcaaaaaaaatttttttcctgggctgggtgcagtggctcatgggtgtactcccagtgctttgggaggccaagatgagaggattgaggacaggagttcaagactagcctggacaacatagtgagaccccatcaaaaaataaaaaaaaaataaaaaaataaaaaaataaaaaacaagtaaaataaataaaaaataaaaataattatataaaaaatattagctgggcgtggtggtgcatgcccatagtctcagcctcccgagtagttggaactataggcacacgctaccctgaccagctaatttttgtatttttagtggagaccccatca

SEQ ID NO: 433377 - DNA, 1249 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433378 - DNA, 466 bp, Homo sapiens
cttgctcatcagactctcctcccaggccctcttcttgtttacttatacccagccctgtaaataacagtgaaagtttgcttgtagacacttgacgttttctcatacaccatgaaaatcgaacctccccctctatgcagttaccccatcagtccccattacaacctctgctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433379 - DNA, 1811 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaaaaaaaaaaaaaaaaaaaaaaaaaaaaaaaaaaaaaaaggggggggccccaaaaatttcccccggggggcccccaagctttccaccgcgccaccgccgagcttttctttggtaccaaaggggggcgcccccaataataggaggagggggcggactatataataaccagcagaggcacaagggcgcccggaggtttacacacacgctgctcgaggaccgggcgcaaaacccggtgctacacctgggggagtcacttgcggagaaagacgactccttattccgcgctgggggggggggagcggcaccaatattatgtgggcggccaaaaaaatgttatctctctataccaggagcatgttttaaagagcgggctcgttaaagaggaggagacactatttctaaatatagttttaagaagggtgggttaaataggggtggtggtgttaaacaataagggtgggtgaataatggtctgtgctagggtgtgtagaagaatagtttgtgcgaataccgagaggaatttatgattttatacgagaaactttttttattactcaggggaga

SEQ ID NO: 433380 - DNA, 1296 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcctcatacccagtgtggagagagtctccacactggctctctccacactttctccatactctctccacactggtctcaagtcagtgtacaggtaagccctggctgcctccacccactcccagggagacccaaagccttcatacatctcaagttgggggaccaaaaagggggaagggggggccgaaggctcatcattcaaaataaaacaaataaaaaagtattaaggcgaagattaaaaaaattttgcattacataatttacacgaagcatgctatcacctccccgtgtggagagacggggatcctctgaacgccacc

SEQ ID NO: 433381 - DNA, 930 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433382 - DNA, 1136 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtaatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433383 - DNA, 1197 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagcgccctcaatacatttggacgctgtctgcgctcagctgcagctcagagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433384 - DNA, 810 bp, Homo sapiens
ggacacgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433385 - DNA, 316 bp, Homo sapiens
ataaatcactaatctattgcgacttccaacctgctgatctgtattaacagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaa

SEQ ID NO: 433386 - DNA, 828 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagttaaaaaaaaaaaaaaaaaaaaaaaaatggggatttttgggggggggaaaagggatgatggactggttaggggtttcggaccagttttgtcaaggggaatgggggcccaaggggcgataatgaaagcgtactattgggggatg

SEQ ID NO: 433387 - DNA, 754 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433388 - DNA, 867 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggtaggg

SEQ ID NO: 433389 - DNA, 649 bp, Homo sapiens
gcggccgcccgcccatcccggcccgctggagccgcgcgcagagctccgcgcccgccgccgccgccgagcctctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433390 - DNA, 1001 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagttaaaaaaaaaaaaaaaaaaaaaaaaaaagggcgcgcgccgcgccccggcgccccggaaaagcgctccaaaaccatccggttggcgcgcgccggggccccaggcggcaaccggagacacagggcaaaacgcgtgtcccaagggaaacccgggaccaagaaccgaggcgcagggaatcccacccaaccaaaaaaccccggggggaaacccgaggggccggagaaaaaactccaagagggaagctccagaggcacaaaaggggaccacacaaaagggggcccaggggagccgaaaaccaaataagccgggccggggcc

SEQ ID NO: 433391 - DNA, 938 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcaggaccagagtgtgtcaggcttcagcagcgcaggaggcagccagggggagggatcctaagaaggcagattaggtgggctcaggtggttgaagtagcctgatcaatatgtggggtcctgggaaggaggtgacaggagggctctgttgctgcgggggacatatcctatatagaggttcagaggtagggctggctagcactctggccagagcctagctttgactctgccttccccacacccttcttcccacctagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433392 - DNA, 751 bp, Homo sapiens
gacccatgcctcagagcatgcagtgaacaagcaacttgcagataaggagcgggtggcagctgccctggagaacacccacctcttggaggttgtgaatcagtgcctgtcagcccgctcctgagcctggctttgacccctcagcctgcatactggtatcctggtcccagctcctgccagggctgtgaccggggtaccattgtgtcacgcagcaatgcagaagagtggacatcctggtgatttgcaaatacccgttaatctataatgcgctctgaggaaagacggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433393 - DNA, 876 bp, Homo sapiens
gttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggtgagtcacttccgaggggagcgagttgttccagagagtcagaaaggtttctgtgcagcaggagctggcgtgctctatgctcacgaacaccgaagggtatctttggggagggagattgttgtgcctattttatgggtgttgaaactgaggcccatagaagttggatgatttgcccaaaacaacaaactaagaagagggaccttgggctgagggtggttgactcttgacatctctcctccacaaccaggttagcgaccccgagagtacagtggctgtggctttcacaccaaccattccgcactgcagcatggccacccttattggtctgtccatcaaggtcaagcttctgcgctcccttcctcagcgtttcaaggtcagtcggagctgagccccgggagtgagaccaggcattgagggtctactgctgaggatggggactgggagagcatgaacatggataggacatcagagtggggcctggaaggatccc

SEQ ID NO: 433394 - DNA, 688 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433395 - DNA, 758 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcaggaccagagtgtgtcaggcttcagcagcgcaggaggcagccagggggagggatcctaagaaggcagattagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433396 - DNA, 256 bp, Homo sapiens
gatgcttacgactagcccgacaggacgcacgcgagattttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtcgggctagtcggggactgtcgggctagtcggggactgtcgggctagtcgggg

SEQ ID NO: 433397 - DNA, 844 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433398 - DNA, 853 bp, Homo sapiens
cgataggtaatgcggcagtagtgagtcgagaggaaggcttcctggacgaatgccaaatgcccctcatctagcaagcgctctgtgtatcggcctgtgactgcccgtggagggaggcataacgcactttcccgatggcaatcgatgcactgcgagatcttctgatatcgcgctcagtcttgtctgggtctgactgggctgggtttcgctgtgggcgtctgtgctgtgtgtggtgtgggagcgacgtgatatcagagctagcctagagattgagcaagactgtaatccccatcacgggcgataccatggcaagaagggttctaagtgggcaagggcgcagagtcccttttccttcacttcccacatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433399 - DNA, 601 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaagatggacgtgcacattactccggggacccatgcctcagagcatgcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagtta

SEQ ID NO: 433400 - DNA, 709 bp, Homo sapiens
agcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaagcttctgcgctcccttcctcagcgtttcaaggtcagtcggagctgagccccgggagtgagaccaggcattgagggtctactgctgaggatggggactgggagagcatgaacatggataggacatcagagtggggcctggaaggatccccattagcagagaggaaactgggaggaagctttcc

SEQ ID NO: 433401 - DNA, 7000 bp, Homo sapiens
  misc_feature (258)..(258): n is a, c, g, or t
  misc_feature (260)..(260): n is a, c, g, or t
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcncnggggaggggggcggccaccgcccgcgccgggcatcctcaggagccccagagcgcggagggcgcggcgccgccgagcggtgctggcccccgcgggctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagaatatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaacatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaa

SEQ ID NO: 433402 - DNA, 6916 bp, Homo sapiens
  misc_feature (258)..(258): n is a, c, g, or t
  misc_feature (260)..(260): n is a, c, g, or t
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcncnggggaggggggcggccaccgcccgcgccgggcatcctcaggagccccagagcgcggagggcgcggcgccgccgagcggtgctggcccccgcgggctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagaatatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaacatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtg

SEQ ID NO: 433403 - DNA, 2489 bp, Homo sapiens
tgtgctgatcctacatcgagtatcgtcgctctgatcgtggatatggaggcgaaactactgatagtgcagttgtagctagggtagcttgtcctgggggtcaggttatagggtcatgagagtatagtagttcgcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaacatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaa

SEQ ID NO: 433404 - DNA, 6527 bp, Homo sapiens
  misc_feature (258)..(258): n is a, c, g, or t
  misc_feature (260)..(260): n is a, c, g, or t
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcncnggggaggggggcggccaccgcccgcgccgggcatcctcaggagccccagagcgcggagggcgcggcgccgccgagcggtgctggcccccgcgggctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagaatatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaacatcctgaagtttttatttagttttgggaataggctccagggggggaagcgtgagactccccagtacataggactgatatgaccggtgaagcggttgacgctataatgctcacggagacgccccataaaggaggggcaacgggtacaagccacaacaattgaatccctctacctccaaggacaaaaaacaaatgtttgacagcaggggagggcc

SEQ ID NO: 433405 - DNA, 7323 bp, Homo sapiens
  misc_feature (258)..(258): n is a, c, g, or t
  misc_feature (260)..(260): n is a, c, g, or t
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcncnggggaggggggcggccaccgcccgcgccgggcatcctcaggagccccagagcgcggagggcgcggcgccgccgagcggtgctggcccccgcgggctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagaatatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtgggactgacatttctcaatggaagtgaaatttgggattggactttgaagacggattactaaataataattattatatgtaactgaagcaacctacttttgaaaatcaactgtattgggtagtgggaggtgggagggaagggctttgggaaggggatgaatatctctttttacctttaacagacttgtttaatcttctcgatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaaaggaaagaaagaaactgataaaaagaggcattccagcccctatgttattgatggaaaaagaaaaagaagaaaagcaatctcgcagtacatgttacttgtcgaaaaaattccggacaagactacccttgttttatgttttcagtattctgaaaataccagtgtgtggcagttctcgcagatgttacctaaaactgctgaacttgaccggcagaatgttctgccgttttctgctccctcgacacttgattggagggctgtcgacctctcctcccgtgggggcttccccagtgcctatcttctctgatagtcatggagaggttacactaattcattggagatgtaagttgttggttttgttttgttttgtttttagaaaaatatatataaatatataatagatatctatcgctatagaataatgcattaataaaatgaggcttttttagaggaagaccaaaaaattcaatgtcttaaaaatatatttaatggcaatgcaaaagtcttcctgcttccgtgctgaactttagaacagaggattgtattgcaagacaaagttgaatgtaaagtgatctccctgaacatttttaaggttttacttttctgaaattatacatcacagcagtgcataggccatataatgttagctggaaggtcaatttcagtgtatgatatactttattaagatgtataaaacatcctgaagtttttatttagttttgggaataggcatcaatgggtggtatttgctttgtaactccccccaggtacgatagggactgaatatggaccctgctgaaagcagtgtattgacgcatatttaactcgccctctatccgtagagtagtcatgacactatacagatggttcgtgttcatactgcagcttaaaacaagcaaaatacacagatgataatatgctaaattttcctctatcctgtacatttcacaaaaaggcatatgcaatatttacatttttaatttagtttacagaatggaaccaaaatgtataaatgttatgtttgctaaaacttcacaatgtatattgggtctttgtacattttgcctgacttaccttaaatttaaaatattttttgctatataaactttaacagttattaaacagtgttttctttttgggtacgtattgtttctggatatcaagatgttaaatatatttcttgctattgtgatatgacaagagacttaacttatcttgctctgtcttccactgtacacgctgtatataggggtcaatgtgatgctgctggagacgagaataaactggactagaatagtgcattgtatttagtctgtattgatcatggatgccctccttaatagccatatgcaataaaataaagtacattatttatgaaatgaaaaaaaaaaaaaaaaaaaaaaaaaagaaaaaaaaaaaaaaaaaaaaaaaagaaaaaaaaaagaaaaaaaagagagaaagaaaaagaaaagagagaggagggagagaagaaaacagcgaggacagacgaaagaaacacagaaaaaaaaaaggcacaaagaaagggaacaaagaagaaagagacgagaagaaaaaagggagaaggacgaaagcgagaggacagagagagagcacacggagggggaaaaagaaacaacacagaaaacacagggagaaaaagcggaggcggaaaaccacaagagcggaaaagaacgagaggagaaaaa

SEQ ID NO: 433406 - DNA, 5248 bp, Homo sapiens
  misc_feature (258)..(258): n is a, c, g, or t
  misc_feature (260)..(260): n is a, c, g, or t
gcggggaccgcgacgagcccgggtcgccgttggcagcagcagcagcaacaccagcagcagcagcagccccggcggcggcgcggaccccgagcgcccgggcgcaccccggcttcccggagcgcgacgcggcggcagcagccccggtgcggccgcgcgcgccttaggctcggccccgcggctcggggaccccgactcccggcccagcgagcgcgtcccccggcgccgcccgagagcccgaggaggcagcggccgcaggcncnggggaggggggcggccaccgcccgcgccgggcatcctcaggagccccagagcgcggagggcgcggcgccgccgagcggtgctggcccccgcgggctccccggaccttccccaccgcctgggcccgagggacgcgtgatcgggcgggcggccgggcgcaagggtgggagggagccgcccccgcccgcgccccctccgcccctcgccccaacccctgggcgccgggcccgggccgcgcggcctgaagcgcccgcgatggcgagcccgccgcggcacgggccgcccgggccggcgagcggagacggccccaacctcaacaacaacaacaacaacaacaaccacagcgtgcgcaagtgcggctacctgcgcaagcagaagcatggccacaagcgcttcttcgtgctgcgcggacccggcgcgggcggcgacgaggcgacggcgggcggggggtcggcgccgcaaccgccgcggctcgagtactacgagagcgagaaaaagtggcggagcaaggcaggcgcgccgaaacgggtgatcgctctcgactgctgcctgaacatcaacaagcgcgccgacgccaagcacaagtacctgatcgccctctacaccaaggacgagtacttcgccgtggccgccgagaacgagcaggagcaggagggctggtaccgcgcgctcaccgacctggtcagcgagggccgcgcggccgccggagacgcgccccccgccgccgcgcccgccgcgtcctgcagcgcctccctgcccggcgccctgggcggctctgccggcgccgccggggccgaggacagctacgggctggtggctcccgccacggccgcctaccgtgaggtgtggcaggtgaacctgaagcccaagggtctgggccagagcaagaacctgacgggggtgtaccgtctgtgcctgtctgcgcgcaccatcggcttcgtgaagctcaactgcgagcagccgtcggtgacgctgcagctcatgaacatccgccgctgcggccactcggacagcttcttcttcatcgaggtgggccgctcggccgtcacaggccccggcgagctgtggatgcaggcggacgactcggtggtggcgcagaacatccacgagaccatcctggaggccatgaaggcgctcaaggagctcttcgagttccggccgcgcagtaagagccaatcgtcggggtcgtcggccacgcaccccatcagcgtccccggcgcgcgccgccaccaccacctggtcaacctgccccccagccagacgggcctggtgcgccgctcgcgcaccgacagcctggccgccaccccgccggcggccaagtgcagctcgtgccgggtgcgcaccgccagcgagggcgacggcggcgcggcggcgggagcggcggccgcgggcgccaggccggtgtcggtggctgggagccccctgagccccgggccggtgcgcgcgcccctgagccgctcgcacaccctgagcggcggctgcggcggccgcgggagcaaggtggcgctgctgccggcagggggcgcgctgcaacacagccgctccatgtccatgcccgtggcgcactcgccgcccgccgccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggcgcatcctggaggaggagcgtctggagcctcaggccacgccagggcccagccaggcggccagcgccttcggggccggccccacgcagccccctcaccctgtagtgccttcgcccgtgcggcctagcggcggccgcccggagggcttcttgggccagcgcggccgggcggtgaggcccacgcgcctgtccctggaggggctgcccagcctgcccagcatgcacgagtacccactgccaccggagcccaagagccccggcgagtacatcaacatcgactttggcgagcccggggcccgcctgtcgccgcccgcgcctcccctgctggcgtcggcggcctcgtcctcctcgctcttgtccgccagcagcccggcctcgtcgctgggctcaggcaccccgggcaccagcagcgacagccggcagcggtctccgctctccgactacatgaacctcgacttcagctcccccaagtctcctaagccgggcgccccgagcggccaccccgtgggctccttggacggcctcctgtcccccgaggcctcctccccgtatccgccgttgcccccgcgtccgtccgcgtccccgtcgtcgtctctgcagccgccgccaccgccgccggccccgggggagctgtaccgcctgccccccgcctcggccgttgccaccgcccagggcccgggcgccgcctcatcgttgtcctcggacaccggggacaatggtgactacaccgagatggcttttggtgtggccgccaccccgccgcaacctatcgcggcccccccgaagccagaagctgcccgcgtggccagcccgacgtcgggcgtgaagaggctgagcctcatggagcaggtgtcgggagtcgaggccttcctgcaggccagccagcccccggacccccaccgcggcgccaaggtcatccgcgcagacccgcaggggggccgccgccgccacagttccgagaccttctcctccaccacgacggtcacccccgtgtccccgtccttcgcccacaaccccaagcgccacaactcggcctccgtggaaaatgtctctctcaggaaaagcagcgagggcggcgtgggtgtcggccctggagggggcgacgagccgcccacctccccacgacagttgcagccggcgccccctttggcaccgcagggccggccgtggaccccgggtcagcccgggggcttggtcggttgtcctgggagcggtggatcgcccatgcgcagagagacctctgccggcttccagaatggtctcaactacatcgccatcgacgtgagggaggagcccgggctgccaccccagccgcagccgccgccgccgccgcttcctcagccgggagacaagagctcctggggccggacccgaagcctcgggggtctcatcagcgctgtgggcgtcggcagcaccggcggcgggtgcggggggccgggtcccggtgccctgccccctgccaacacctacgccagcattgacttcttgtcccaccacttgaaggaggccaccatcgtgaaagagtgaagatctgtctggctttatcaccaggatgtcacatgtcagagaatatcattaaaagaagacgctcagcactgtttcagcccgaagctgcttgcagttttcttttggatctgagcaatgactgtgtttggaaacatctgtggactctgttagatgaggcaccaacaaggcaaggtcacctgcctctttcccttgttcccggatggggcattcatcattgtgctgtttgcgtttgttttgttttgttttaacaaaattagctgaagaagttattctcaagaaaattggatgttttcattggccttcttaaattgtggccagtgtcttttaatttcttcttcttttccttttggcaaagcagatataaccctcagcatgctaggagagtgcacccgtacctatggaagtggtaaaatctggtatttactggcttacactcaaaacgaccacagtcctacctcagttcaaggtaaagccggatttccgtggcgggggtcccacaggacctcctgtagtagcccctgcgctgtgtgtctggagcgcggtcctcggccttattgaaatggtccaagtagacagctgcttgttggattccagtgcaggtacctgcgatgtttacgtccacaccgagcccagtgtggagagagcatttagcagaaatggtaatgacagtgatataatgcctgtacctgttgtccagtgtggacgagacgggatcctc

SEQ ID NO: 433407 - DNA, 511 bp, Homo sapiens
gctaacatggcatttaactacaaattgtgaagagctgtcaggagctataaaaatcatacttcagtagggacttaagctgaaagaacattcacccttttcctcaatcagtcagtcagtcaatgaaaattgcttttgtatagtgctcttcatgacatgcatcccaaagtgaattacagcaaaagggaaatcatctgctcttttttcatttctgtgtttagactgaaatgatattgctcaacattttgacatactaaccaagacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagtcagattttctaatgttaataaagacatttccagtgatccttaaataaaaaatatgctctttatgtaacccattagctc

SEQ ID NO: 433408 - DNA, 836 bp, Homo sapiens
ccgcgggcgtctggggcttccgcggcgcccgcctctgctccctcccctcgggcgctgggtgccgaccggccggctggccggcgccgctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtaagttatttgataattcaacttcctagttagaatatttgggaaattttaagagtttcaaaagaatttcagttgaattttccccccagttttgccttttaaagaattattgtggacagacttaagtatagtaaatttgcataag

SEQ ID NO: 433409 - DNA, 583 bp, Homo sapiens
ccagttttagaagttccaatagcagttttaaattattactaaatcacctgaaaaaaattcccaaagagaaccacacactaccatatcctaacaacttttgcatttcccataattgtagttaatgtcagcccagtaggccagaccaacccccagttcaatactttccttccccaaaagctctatactttgaaggaaaacagatacagtatcaaattatgacactttccttgctattggtttatttttacattttctttttgtttcactggaaaggaaagatgatgctcagttcctagttttagaagtttcaatagcattacaaatattcgacaacaactttataccagaagatgtcaagcgtatgttgatcgggctggcaagagatcttcgagggattgcctttgcactgaacacaaagaccagctacaccatgctgtttgactggatatccttttaagaaaacttgtgaagatagatgctattgaaacttctaaaactaggagttttagaagtttcatagcacctagttttagaagtttcaatagcactcctagttttagaagtttcatagcagaataaattt

SEQ ID NO: 433410 - DNA, 3705 bp, Homo sapiens
ccgcgggcgtctggggcttccgcggcgcccgcctctgctccctcccctcgggcgctgggtgccgaccggccggctggccggcgccgctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggtt

SEQ ID NO: 433411 - DNA, 1983 bp, Homo sapiens
ccgcgggcgtctggggcttccgcggcgcccgcctctgctccctcccctcgggcgctgggtgccgaccggccggctggccggcgccgctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggatgcacctaaactattgatgattaatcaccttattaaatgattccattctgtgtaaa

SEQ ID NO: 433412 - DNA, 1750 bp, Homo sapiens
ccgcgggcgtctggggcttccgcggcgcccgcctctgctccctcccctcgggcgctgggtgccgaccggccggctggccggcgccgctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaagttttcctctataagattgataggatatacttctctctggaatcaatatgaagaaaaattgataatggcccttgagcagatagtttatgaacataactatcttaactggttgtgttttcttctttgctatacttgattgcaaactcagaacccaatttcagccaataaaaagtatataatatatca

SEQ ID NO: 433413 - DNA, 336 bp, Homo sapiens
atgaaaattgggagacttaagatgctttggggttttactgattttattgtccataggttggcttgtttttaagcctttctttttgtctcataatttagggtttgtctgatccaggtaattatcatgaattttgtcgatttttggctcgtttaaagacaaattatcagctgggagaattagttatggtgaaggaatatcctgaagttattagattgattgctaattttaccattactagcctacaggtaggtaaaaatatgtaattatgttaaactgtagccagttttaaaacagcttcttggtaagggttggtgggggtatttgaaaaatatctat

SEQ ID NO: 433414 - DNA, 3630 bp, Homo sapiens
gtgctgcaggcttgaggaacgaggcacgaggcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggtt

SEQ ID NO: 433415 - DNA, 635 bp, Homo sapiens
gtgctgcaggcttgaggaacgaggcacgaggcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggtaagcgagcctttccatctaacaggagcctgagtttgcttaagtaatgctgtttcttttctgcttttatttgtggcaaaatagacagccttcattttgtggcataaaactctgaataatcaaa

SEQ ID NO: 433416 - DNA, 1059 bp, Homo sapiens
ccgcgggcgtctggggcttccgcggcgcccgcctctgctccctcccctcgggcgctgggtgccgaccggccggctggccggcgccgctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaagtaagaaaaaactttggtatgaagggtcatcaacataaaggcacagtattaagcaatatagtttctgtatgtatagttatctttttgccaggaattaaaaaaatagctcaaatggatttgtaacctgaagtagctgctgatagctaatattgaaatgttttctgtaattcatattatagtaacttctatattttgatttagg

SEQ ID NO: 433417 - DNA, 3097 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433418 - DNA, 574 bp, Homo sapiens
gggcggggagagggccgacaactgagtctcaaagaggactggactggcgtatccagactcctggatctgagggaggaggggctgggggcctggactcctgggtctgagggaggaggggctgggggcctggactcctgggtctgatggaggaggggctgggaatccggagtcctgggtctgagggaggaggggctgggaatccggggtcctagcgctgaggtttgccattctcatgtcccactcatcctctccaggtggaaatttggactcccagggagaccctcttcccggtgtgccgctgcctcctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433419 - DNA, 655 bp, Homo sapiens
aaacaatctagttacaccctttaatttatttaaaaatgtacaattaaattattattgactatagtcattctgttgtgctatctaatagtaggtcttattcatccttttctttttgtaccaattaaccatcccccacctctcccccatgtacacacccccacccccaatcttctttttttttctagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatgggctttggcgggacatctgttcccagcttttaatgcgccccgggagccaattcgggcgctaggacctgtcttgaaggtcccccccgagattttggaccacctgcgattgggggcgtgttctggtccccctt

SEQ ID NO: 433420 - DNA, 2876 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433421 - DNA, 2965 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcagacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433422 - DNA, 2864 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433423 - DNA, 1407 bp, Homo sapiens
gccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433424 - DNA, 1081 bp, Homo sapiens
aggcagggaaagaccagcagagaggaaagagaaactgggagagggaggaagggagaaagtgagaagggaaatcggaaagagaaaagggaggaaacggcagagccagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433425 - DNA, 2910 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtgagcatcctggttgggtgggactttacggaaattcccgtcctcaccaagtcccgttctgtctttccaggtcttgggtctccgagggtctcccgggcttccagccctgagggtcgccacctcccttccccacagctaggaaccaaggtaagctgtaggtccatcctgtaatccttgcatctgaccatcagggacccccacacttctgggaaacagctaggagtagagcgttctaaggccatactcagagcagagagagcactgcttgttaagagcattgagattgatttttgtctctgtcgcttctaagctgtgtgactttgggtcagttattaaacctctctgtgccttcattttttcttctctaaaatggggctaatagcagaacctaccacctagagctgacatcaagatgaaaactagatgaatgaggccaggcgcggtggctcacgcctgtaatcccagcactttgtcaggagttccagaccagcctggctaacatggtgaaaccccgtctctactaaaagtacaaaaattagccaggcgtggtggtgggcgcctgtaatcccagccactcgggaggctgaggcaggagaatcgcttgaactcgggaggcagaggttgcagtgagctgagatcacaccattgcactccagcttgtgcgacaagagcaaaaatctgtctcaaa

SEQ ID NO: 433426 - DNA, 2840 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggtaagctgtaggtccatcctgtaatccttgcatctgaccatcagggacccccacacttctgggaaacagctaggagtagagcgttctaaggccatactcagagcagagagagcactgcttgttaagagcattgagattgatttttgtctctgtcgcttctaagctgtgtgactttgggtcagttattaaacctctctgtgccttcattttttcttctctaaaatggggctaatagcagaacctaccacctagagctgacatcaagatgaaaactagatgaatgaggccaggcgcggtggctcacgcctgtaatcccagcactttgtcaggagttccagaccagcctggctaacatggtgaaaccccgtctctactaaaagtacaaaaattagccaggcgtggtggtgggcgcctgtaatcccagccactcgggaggctgaggcaggagaatcgcttgaactcgggaggcagaggttgcagtgagctgagatcacaccattgcactccagcttgtgcgacaagagcaaaaatctgtctcaaa

SEQ ID NO: 433427 - DNA, 1512 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattgggtccccattgcgggcccgggaggggaatggtttctatggccaaagtttggttttctcaacactgtctaaatttggattaaaactttgaacttttaaaaatagct

SEQ ID NO: 433428 - DNA, 1195 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacttgttcacccacgtctctcgccctcctcgctcttgaagctcgggaggatgcgtg

SEQ ID NO: 433429 - DNA, 620 bp, Homo sapiens
  misc_feature (563)..(563): n is a, c, g, or t
  misc_feature (571)..(571): n is a, c, g, or t
  misc_feature (574)..(574): n is a, c, g, or t
  misc_feature (577)..(577): n is a, c, g, or t
aaacttacggctaggtagcgaggctgggtgggctcaggagggatcccaaccttcccgtgcacatccgaggctggcttcataagcagacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctccggcganccgactgnccnggnaggagaccctgaggatagagaaagaaaagaaagcgacacgcga

SEQ ID NO: 433430 - DNA, 3038 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433431 - DNA, 1711 bp, Homo sapiens
  misc_feature (1)..(1): n is a, c, g, or t
nggctggtactggcccggagatgtaatgtgtgtgacttgctggggctcccgtgggggtcacagcctgtcggggagaagactggaggggaagatgccacaaagcggacattactgaggatttggacagtagaggaggattctaacccagtgggacagtaagacacagtgaagtgagacatgtccttgaggctgacttgatgggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433432 - DNA, 2953 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctcctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433433 - DNA, 3167 bp, Homo sapiens
  misc_feature (2907)..(2907): n is a, c, g, or t
  misc_feature (2926)..(2926): n is a, c, g, or t
  misc_feature (3091)..(3091): n is a, c, g, or t
  misc_feature (3098)..(3098): n is a, c, g, or t
  misc_feature (3132)..(3132): n is a, c, g, or t
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagcctgagcctggccagcagcgcctccaccatctcctcgctcagcagcctgagncccaagaagcccacccggnaggtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacnaggacanccgcgaagagagtgtccttaggcaagcgttctgntccccagctacaatatttagaccagatgggcccgg

SEQ ID NO: 433434 - DNA, 1739 bp, Homo sapiens
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaatagct

SEQ ID NO: 433435 - DNA, 1282 bp, Homo sapiens
  misc_feature (1225)..(1225): n is a, c, g, or t
  misc_feature (1233)..(1233): n is a, c, g, or t
  misc_feature (1236)..(1236): n is a, c, g, or t
  misc_feature (1239)..(1239): n is a, c, g, or t
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcagacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctccggcganccgactgnccnggnaggagaccctgaggatagagaaagaaaagaaagcgacacgcga

SEQ ID NO: 433436 - DNA, 6822 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433437 - DNA, 6768 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgttttttttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433438 - DNA, 7150 bp, Homo sapiens
  misc_feature (7150)..(7150): n is a, c, g, or t
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaaaaaaaaaaaaaaaaaaaaaaaaaaaacactctgtgggggcgcgcgcttgggccttggaaaaaactttctaaacccttcgcgggggggcggcggggccccaagtggttcagggaactgtggccaaaagcgctggtcccaaggagagacccggggacaagcgacaagggcgcggggtttcccacccaaaaaaaaaagcgcgggggggcgaacccggggggtcgcggaaacatacccagagagggggctccgagagggccaagacggggccctccacaacggggagccccaggagacgcggaaataaaatacgcggccgcgcggcgggcgn

SEQ ID NO: 433439 - DNA, 4839 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaact

SEQ ID NO: 433440 - DNA, 4567 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgttta

SEQ ID NO: 433441 - DNA, 5957 bp, Homo sapiens
taaagactttttaacatgatctgattcaccagtcaatgagctttcatcaattttaagatcgttgccttgaataagtatgccgtcagctggaagaagatcaccatatttcacttgagcaatatctccaacagtaatgtcagctacaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433442 - DNA, 6714 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433443 - DNA, 7279 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433444 - DNA, 5005 bp, Homo sapiens
tgctgggcctgccccacagtattcgctaagatagatctgggtccatgcccaagaattcacgtttctaacaagttcccaggagtttctgattgttctgtggaccacactttgagagctactgataaatatgccagatagctcattaggatttaagaaactatgtttgggcatattttaactttgataaacacttatagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433445 - DNA, 7433 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433446 - DNA, 3371 bp, Homo sapiens
cgtgcagcagggtggatggactcggagttacgtttttgtatggagcatcatctatcggcatcagtgtcatcaatcagggggatatagaggctctgaatcttctatcctaaactcaggatgtgtcatagctttgtcctttcttaacagtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433447 - DNA, 6974 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacaagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433448 - DNA, 4295 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggggccaagggggggggggggaaatgtatgggcgattaacgggtacccagggaaagaccggggggcaccgaggtcccagcgaggcccgacaggtgttcgccagctctataccaccgcgtgcgaaagaggggaaaggcgcaacaaaccgcggttcaaagagcgggagggaacaagaagcgttacacaaacataagggaacaatagatacgaacacctgaagagcgct

SEQ ID NO: 433449 - DNA, 4202 bp, Homo sapiens
  misc_feature (3340)..(3340): n is a, c, g, or t
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcacagagaggatacgaccaagatttggcgccaataaatttcgagattaactggcaagagatcatatcgctacatgattaagcatataacctgggttacaagggctaaacttgagcaggacacggctcacagacccacaggccaggttgtaccatcgaacaggtgagtgggtcaacatgtgatgggcccagccttcaaaagaacaattttggacaacgacacgagaattggcggacagattgaagttgatacaagaaacagcagacggaattatataacaacacaaagaacccatatacagataagtatagaaggatgttcgtgttgtgcgacaagtgcttaaagagcagatgcgagattaagaaacaataacgagtagaaagctagcagagagggtgctaagaagcgcaatatgatcagtcaacgagagcacagtgcggtgtgatgttcttttgtctgctttgatctctgatacgacgagttaagataataggtatacgaggaaatgctcgatcggcgactccgttcccgtgtcctctcggcggcgacggagaaggaggtagagaaggagagaagaggaaagaagaagggagaagggcgagaaagaaagatgagagaaggaggaaagaagagacgaggaggaagagagaagagagaggagaggaagggagcgaaggaaggaggagagaaagaaggacagtagataggaagagaaagataggaggaagagaagaggaagaagagaagaggagagaaatggagacgaagaaggagagaggagagaggacgggagagagagagagagagaaagagagagatagagagagagagagagagagagagaggaggagagagagagagagngagacctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 433450 - DNA, 3315 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcgactcagtgggtggttccgttgccagagccagggaagcgagtgtatccattatgaggtttacccacagcatctcacagccttaagcgggagtcctagaaaagatatgtttcctaatagacattcacaactactcaggggctcagccagtct

SEQ ID NO: 433451 - DNA, 2806 bp, Homo sapiens
cggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagaggtaaagatttattattattttgtttttggttgacagatgtttaatatattaggaatttaactcaacaaacacatattgaatatgcactgtgttaggcaccatgcatgaaataaatgcagtctataccttaggaagcaaaatactagtgttctaagggataaaagagagaagtaataaattggtactaaagggagtaagcatttcttgctatgaatgctatataaaagtagcagcagtgaatctaggccaatttcagaagtacagtatgtataagggagtaatgggagatgagttggaaaggctgatatggagcatattttagggggccccaaact

SEQ ID NO: 433452 - DNA, 325 bp, Homo sapiens
tgagattaagaattacagaagcagggaacttgaaagtgacatagagttcttatggaatactttgaatttaataaagtatttattgctataagtaaaattgataaacataattaacacaaaaatatgatttagacgtactatatgtatgttgtcatcaattcaggaatctttttgataagcattttctttctttccaaatagtttgtggagaagtttctgttggggaggaagaaggtgaaggtgaaactggttggattgaaggagctgcaatcctcttgtctgtagtgtgtgtggtgttagtaacagctttcaatgactggagtaa

SEQ ID NO: 433453 - DNA, 301 bp, Homo sapiens
aagaccctgacttaaaaatatatatatatatttatatatatatttatatatttatatttatatatattttttcctaaatgttgaggctgttaaaaacaatattactgaagtttgaaatttggtggtagcaaggagatctatcagtatttttaaaaacaaactatgtttttggttataggtactcatgtaatggaaggctctggaagaatggtagttacagctgtaggtgtaaattctcaaactggaattatctttaccttacttggagctggaggtgaagaggaagagaagaaagatgaga

SEQ ID NO: 433454 - DNA, 568 bp, Homo sapiens
ttttggtggacattctccgttcaagaagctaagacgggttatagtaaattttaaatagatttcaacataaatggttgataacaaagtcagcttcaggtatgcatgttagatgacgtgagactaaccacccatcccgcgggcacccctcgttccaccttgtatgtggctttctgcgttttctccagagcgcacaagggctggtgagaagatgctggaagtgtggcaactcagggtgtttggttgcccaaaagcatgtctggtgtggctttcccagctacctggtgtcatgagactgatcactgagtctcatgatttggtcattgaaacaaccagaaaggtctctgacttctctgtcccctcttctcttcctacgggtcggactcgggaacatcaataggaggtgctcctgtaccctggccacagcccaatcctgccactgctgacatctggggagactttaccaaatctacagggtaaggagggccatgttctgcggaggggctggggccagggccgttgctctacaaacctggtattgttccacatgcctgccttctggtgttaggat

SEQ ID NO: 433455 - DNA, 2066 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433456 - DNA, 2053 bp, Homo sapiens
  misc_feature (17)..(17): n is a, c, g, or t
aaagcaggctggtacgncccggggtgtaaaggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433457 - DNA, 1855 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433458 - DNA, 4689 bp, Homo sapiens
  misc_feature (17)..(17): n is a, c, g, or t
  misc_feature (1668)..(1668): n is a, c, g, or t
  misc_feature (1732)..(1732): n is a, c, g, or t
  misc_feature (2676)..(2676): n is a, c, g, or t
  misc_feature (3129)..(3129): n is a, c, g, or t
aaagcaggctggtacgncccggggtgtaaaggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcagtgagttctacccttgcttggctgtggtgacgtgatacttgtggccacccagccccagagcccattgctcttcttacagttcagctccttcagttcagcagatgtttagtgagcatctgccttgtgccaggtcctgcatcggggtgaacaagagacctctgttctcatggagctcagagttgagctgagacaggcaggtaaaaatgtgataacaacatggcaggaaaggttccatgactaagggatgccctgggtgccgtgggctcctagaggaagggtgtgcagcccatagttgtgggaaccaaggaaggcttcctggaagaagggacctgtaggcaagggaagagtgatcaaagagtggttcacacagaggaacagcaggtgcaaagcctctgaactgagaaggagcatcagtcatttgctgccagaggtggtgtttctgtcctagctattagagtgcatcaggagggacctgtgtgctcatcccaggctgtgtcttgaataaggaagatttgggagagttctggcaggagggcgttgaggtgggcgctgggagtcctgggcagcttgtgctgatggtgttgtcctggctcctgtgtcttcgttctgagctgctctgcctctggcttccctcccgtcagctcctgttcataggaacaggttgggctgggctgggctgggctgggttgcctaaagttggcctttacctggctgcaagggtggagaggggagatgaggtcagagtcatgattgcggggacccaaggaccaagtggattggtttttgtttttgctaggaatactgtgttgagatggatttgttttttcaagaagctttgtaactctaaaataatgcttttcctctttacttactctttctcctcttttctgcttcgtgctggtgatgatttgggatccttgaagttggccagctggcccttaagagagaaatgcaagtccaatccagtggactggttgggatgtgattctttctctcgcttggaggaaactaacatttaatgagcatcagctgagggccaggtagtggtttttttttgttttgttttgttttttgttttgttttgttgttttttttttttaggcatttntcatgtgaattaaacatcctctccctttcctccatgagatgaggaaatggaggcttagggaggnttggggacttgcccagggtcacagagctagaaataactggcacagctgtgctcacactgaggtctttgaggtcttttgacttcagggctggacttacgattttattaagctgctgctttccttacaagtagggaacacattatcttcatctgtgtaacttgtgctgctttctggctcatgcttggtgctcagttttttttttaaagcattttcttgaagtataatgtgcatgtaaaaaagtgtacaaatcataaatgcagaactctgtgaaatttaaaaaatctaatctataggctgggagtggtggctcacgcctgtaatcccagcactttgggaggctgaggtgggcggatcacctgaggtcgggagtccgagaccagcctgaccaacatggacaaaccctgtctctactaaaaatacaaaattagccgggcatggtggtccatggctgtaatcccagctactccgggggctgaggcaggagaattggcttgaacctgggaggtggaggttgcagtgagctgagatcgagccattcattgcactccagcctggacaacaagagcgaaactctggctcaaaaaacaaaacaaaacaaaacacccaatttataaacttgcaccttgctcaagatgcaaaagattgtcagcactctggaaacacctctcctggcccctcccagtaactgccctgagtaaccccatcctgacttcacataccctagattttgtttgttcttaactttcatgaattgaatcatacacctaatcttgatttggaatgatttctttcttttactcaatgtaatttttgtgagagtcatccatggtgttgcgtgtagtttgttcattctcattgttgtggcatgtaccattgtgagaattcacccgatttatttatgttttactgatgatggacatttgggtagtttccagtttggggcnattacaaataatgctgctgtagatgtttgagttcatgtttttggtgcatatatgtatgatttctgttggtttatatctaggagtggaactgcggagtcataagtttaagttcctatgttgagctttataatcctttcaaataatttttcaaagtagttttaccagtttacacttaagccagcagcgcgtgaatggttacttcatatcgtagtcaatacttgataatctacattttagccattctggtgagcgtgtaatggtatatcattatagctttgatctgcatttccctgatgaatgaagtgggggtgctgggttttaaaatggaccttatttgtgagagattcagaatgatgatgcactaagtatagctcatagcaatggaggtgctaggtaggaccatcttttggttacacagatgttgggggtctggggtcaccttggccctccttntggggttttctggtagcattgggactccagcagaacgggctgatttgcattcctcttccctctttagaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433459 - DNA, 1975 bp, Homo sapiens
  misc_feature (17)..(17): n is a, c, g, or t
aaagcaggctggtacgncccggggtgtaaaggtggaagtcgccggaagttcggtgggctccaggcgtcgcgatggaggagagcggggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433460 - DNA, 1990 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcagatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433461 - DNA, 2012 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaatgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433462 - DNA, 2507 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaattgtatgtgaaagatgaatgtgtttctggccgcgtggctgttaaactcttcagggtgccacagctagactcacggccacttctctcaccactgaccaagtgtccagattgaaagttcagggctggggtgtgaggctggccaaagtgaggaaatgcaaccttgttgtctaaggcaatcggtaccttctctcctgtgttctctaggatagtacagtcttttcatcatcctttggttgatgtgaaagtagttgcttgaatcactttgtgtggggcttaattctcttgtggcgtctcatgatacaggccgttctagagagcctggccccttgctttccgtcttccaccaaacctaccggcagagcatctccctaagtagtaaaggggtgcagatacccagaggtcaaaagtaaaattggcacccggctgttagaccccatttctt

SEQ ID NO: 433463 - DNA, 3683 bp, Homo sapiens
  misc_feature (662)..(662): n is a, c, g, or t
  misc_feature (726)..(726): n is a, c, g, or t
  misc_feature (1670)..(1670): n is a, c, g, or t
  misc_feature (2123)..(2123): n is a, c, g, or t
ccccttccaacatctcatccctccttccaacatctcatcccaggctgtgtcttgaataaggaagatttgggagagttctggcaggagggcgttgaggtgggcgctgggagtcctgggcagcttgtgctgatggtgttgtcctggctcctgtgtcttcgttctgagctgctctgcctctggcttccctcccgtcagctcctgttcataggaacaggttgggctgggctgggctgggctgggttgcctaaagttggcctttacctggctgcaagggtggagaggggagatgaggtcagagtcatgattgcggggacccaaggaccaagtggattggtttttgtttttgctaggaatactgtgttgagatggatttgttttttcaagaagctttgtaactctaaaataatgcttttcctctttacttactctttctcctcttttctgcttcgtgctggtgatgatttgggatccttgaagttggccagctggcccttaagagagaaatgcaagtccaatccagtggactggttgggatgtgattctttctctcgcttggaggaaactaacatttaatgagcatcagctgagggccaggtagtggtttttttttgttttgttttgttttttgttttgttttgttgttttttttttttaggcatttntcatgtgaattaaacatcctctccctttcctccatgagatgaggaaatggaggcttagggaggnttggggacttgcccagggtcacagagctagaaataactggcacagctgtgctcacactgaggtctttgaggtcttttgacttcagggctggacttacgattttattaagctgctgctttccttacaagtagggaacacattatcttcatctgtgtaacttgtgctgctttctggctcatgcttggtgctcagttttttttttaaagcattttcttgaagtataatgtgcatgtaaaaaagtgtacaaatcataaatgcagaactctgtgaaatttaaaaaatctaatctataggctgggagtggtggctcacgcctgtaatcccagcactttgggaggctgaggtgggcggatcacctgaggtcgggagtccgagaccagcctgaccaacatggacaaaccctgtctctactaaaaatacaaaattagccgggcatggtggtccatggctgtaatcccagctactccgggggctgaggcaggagaattggcttgaacctgggaggtggaggttgcagtgagctgagatcgagccattcattgcactccagcctggacaacaagagcgaaactctggctcaaaaaacaaaacaaaacaaaacacccaatttataaacttgcaccttgctcaagatgcaaaagattgtcagcactctggaaacacctctcctggcccctcccagtaactgccctgagtaaccccatcctgacttcacataccctagattttgtttgttcttaactttcatgaattgaatcatacacctaatcttgatttggaatgatttctttcttttactcaatgtaatttttgtgagagtcatccatggtgttgcgtgtagtttgttcattctcattgttgtggcatgtaccattgtgagaattcacccgatttatttatgttttactgatgatggacatttgggtagtttccagtttggggcnattacaaataatgctgctgtagatgtttgagttcatgtttttggtgcatatatgtatgatttctgttggtttatatctaggagtggaactgcggagtcataagtttaagttcctatgttgagctttataatcctttcaaataatttttcaaagtagttttaccagtttacacttaagccagcagcgcgtgaatggttacttcatatcgtagtcaatacttgataatctacattttagccattctggtgagcgtgtaatggtatatcattatagctttgatctgcatttccctgatgaatgaagtgggggtgctgggttttaaaatggaccttatttgtgagagattcagaatgatgatgcactaagtatagctcatagcaatggaggtgctaggtaggaccatcttttggttacacagatgttgggggtctggggtcaccttggccctccttntggggttttctggtagcattgggactccagcagaacgggctgatttgcattcctcttccctctttagaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433464 - DNA, 1712 bp, Homo sapiens
ttttggtggacattctccgttcaagaagctaagacgggttatagtaaattttaaatagatttcaacataaatggttgataacaaagtcagcttcaggtatgcatgttagatgacgtgagactaaccacccatcccgcgggcacccctcgttccaccttgtatgtggctttctgcgttttctccagagcgcacaagggctggtgagaagatgctggaagtgtggcaactcagggtgtttggttgcccaaaagcatgtctggtgtggctttcccagctacctggtgtcatgagactgatcactgagtctcatgatttggtcattgaaacaaccagaaaggtctctgacttctctgtcccctcttctcttcctacgggtcggactcgggaacatcaataggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433465 - DNA, 1299 bp, Homo sapiens
cgaaccgccagtgactgtgcgagctccgatacggacggggagaggaaaagggagccttggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433466 - DNA, 1294 bp, Homo sapiens
agcagcgcggcccggcgcgcgcgccggtgccgggcgcaagggggggtaggtacacatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433467 - DNA, 974 bp, Homo sapiens
  misc_feature (14)..(14): n is a, c, g, or t
  misc_feature (66)..(66): n is a, c, g, or t
tttactgagctccntcttctagccattcacagttcctgaaggagaaaagaagttgtttgcagatangcactttagaaaccaccaaagagaaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433468 - DNA, 846 bp, Homo sapiens
  misc_feature (14)..(14): n is a, c, g, or t
  misc_feature (66)..(66): n is a, c, g, or t
tttactgagctccntcttctagccattcacagttcctgaaggagaaaagaagttgtttgcagatanggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgttcatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtcaaa

SEQ ID NO: 433469 - DNA, 941 bp, Homo sapiens
agcggagggagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcagtccagtcagagggtctggactggcaagccatctgcactggtgctctgggggttccaattacgttattcggaaacagcgagagtggcattgacggcgggtcctagatagagaggcccatcgcaagggagggcaccacgagggggagaacactgtgcgcgaaagggagagccgaatcgatacaaaaacatcc

SEQ ID NO: 433470 - DNA, 1078 bp, Homo sapiens
  misc_feature (17)..(17): n is a, c, g, or t
aaagcaggctggtacgncccggggtgtaaaggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacaggtgactacccaccgccagaccaggctagctccaatttaaccctttctccgccacccggacacacccactgcgggaaccgaggacagccctggccagttttggggcgagggggagctaatgctgctgcttcttccagttccaggcccgagcagggaggcggatccagagtttcgcccgtctcagttcgacgcacgggactcctggcggcggggagggcgttaaagccgtatctagcgcttagggaccccggtgggctgccgggtaccctaaacttggtcgggggtggtgatgtcacagacgcttctctttcagcgctaaccggtggccttgaagggatcctcgaaaagccttaagcggggaggtgccctatcacagacggaaatccccgagaggaggggagggagcccagagccggctgaaaggaccggtcccggggagctttaaggtgacggtcgaagcccagggaccccttcctacccagatcccttcgcacgaatttcacccttgatcacagcctggagcagttgggaggaccccttctatatttctctggtctctacctgagacgaataaacacacacgcttgtaaacatactgagtatctctgcaaaggaacacaggaaactgccctaggggaggggaaccgcccttggaaggaaacttcctttcccttttgtgctgtttgcgttttactactctttgtatgcgttatctatcaaaacgacgaaaaatattaaaagaaaaaagatacacttcatacagacaacctggcctatggctattttgtgccactgagtggtggtggggagtgctcgtatttgcgggggcctgggtggctcttgaaggcgatggttgtccaagtttttcggaaatacaggattggtctgcaccccaagaatgatggaacgtccacat

SEQ ID NO: 433471 - DNA, 766 bp, Homo sapiens
  misc_feature (17)..(17): n is a, c, g, or t
aaagcaggctggtacgncccggggtgtaaaggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagcgctaaccggtggccttgaagggatcctcgaaaagccttaagcggggaggtgccctatcacagacggaaatccccgagaggaggggagggagcccagagccggctgaaaggaccggtcccggggagctttaaggtgacggtcgaagcccagggaccccttcctacccagatcccttcgcacgaatttcacccttgatcacagcctggagcagttgggaggaccccttctatatttctctggtctctacctgagacgaataaacacacacgcttgtaaacatactgagtatctctgcaaaggaacacaggaaactgccctaggggaggggaaccgcccttggaaggaaacttcctttcccttttgtgctgtttgcgttttactactctttgtatgcgttatctatcaaaacgacgaaaaatattaaaagaaaaaagatacacttcatacagacaacctggcctatggctattttgtgccactgagtggtggtggggagtgctcgtatttgcgggggcctgggtggctcttgaaggcgatggttgtccaagtttttcggaaatacaggattggtctgcaccccaagaatgatggaacgtccacat

SEQ ID NO: 433472 - DNA, 1364 bp, Homo sapiens
aactgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggtcatgtctattggtgtattatttcagtatcaccaatgttttcagaaatacagtactaattcatcattaaactctttgaagttaatatttttctgccttctaacttatagactcaactatgtatctgtagtttttgggaatggttggtgttttttgctttgtgttgggaagttattgagaaaacctatataataaaatttaaaattata

SEQ ID NO: 433473 - DNA, 383 bp, Homo sapiens
aactgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagc

SEQ ID NO: 433474 - DNA, 548 bp, Homo sapiens
aactgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacaggtatgttccaccagttctcttgtagattagattgtttgtctaggctagctcttatcttgaccgaactgtttcttgcagtgtttgaccaattaacgttccagtttttaacttg

SEQ ID NO: 433475 - DNA, 1219 bp, Homo sapiens
ctattacggtgttcttgtgttgtgataagggtggagaggttaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggtcatgtctattggtgtattatttcagtatcaccaatgttttcagaaatacagtactaattcatcattaaactctttgaagttaatatttttctgccttctaacttatagactcaactatgtatctgtagtttttgggaatggttggtgttttttgctttgtgttgggaagttattgagaaaacctatataataaaatttaaaattata

SEQ ID NO: 433476 - DNA, 1064 bp, Homo sapiens
aactgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaaccctt

SEQ ID NO: 433477 - DNA, 972 bp, Homo sapiens
agcggccgctcgcgatctagacccacgcgtccgaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggtcatgtctattggtgtattatttcagtatcaccaatgttttcagaaatacagtactaattcatcattaaactctttgaagttaatatttttctgccttctaacttatagactcaactatgtatctgtagtttttgggaatggttggtgttttttgctttgtgttgggaagttattgagaaaacctatataataaaatttaaaattata

SEQ ID NO: 433478 - DNA, 431 bp, Homo sapiens
ttaaaaactaagcattgaaaagtttgttttgtagcttgtacctttttgtttccttatgatggaattgacttttgaatattttgattctataattttccttagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttg

SEQ ID NO: 433479 - DNA, 1017 bp, Homo sapiens
tatttttaaagcatttcagtttatgttgctgaaacctgagagcgcccccctgagctagactcagtaatcattagacacatttttggataagcaaactgaatcagagaaggtgagtggcaaagcccatgtagctggtggcattactagaacttagcactgtgatgcacaaaggcttaactgggtttggcagcaagggtctcatggatactctttaagatgtaggcccagatctcttagtagtgaatccctgatgttccctctcttggggctctggtttagcaaggacagcgaggatactttcctctctccctcctccttactcctctctactaaggattaaggagccacctcttcctccttaaggcctttgggagagatgggtctcctggtattagaaaggagagcagacgcctagagttctgacctcttgggcctcccctaaacaaaaagcatagccccttcactaccctagtaacaagtatgacctgttgcctgttgaggtcaggtgtacctgtgtgtctctctctgtgatgtatgtgggcttggtgtccacatcaatgtgcgtgaatactcctacccacagactgctactgtgccaatatagaggttcataagaaagataaaagagaaccagcagaaccccaggttctgcctctccttcctccctttgcccagataaaggtgtacagtgtttgtggtgaggctgctggacactgctgttttgggctttctagagagaatgcaaacatgcaaaaacagtgtggtagtgtaggcagaacaagatctagaatcagaagacctggagtcgaatctcagctccaacacccactggatgaacgtggacaagctgcttgatctctcagatcctcgatttcttcatctgtaagatggaaacaatatgtgtcttttctaaggggaaagatcaaatgacatcatgtatgtgaaaatgcttagaaatgggtgatgatgatgatgatgatactgattattagggtatctaataaagttggggaaaga

SEQ ID NO: 433480 - DNA, 3240 bp, Homo sapiens
tatttttaaagcatttcagtttatgttgctgaaacctgagagcgcccccctgagctagactcagtaatcattagacacatttttggataagcaaactgaatcagagaaggtgagtggcaaagcccatgtagctggtggcattactagaacttagcactgtgatgcacaaaggcttaactgggtttggcagcaagggtctcatggatactctttaagatgtaggcccagatctcttagtagtgaatccctgatgttccctctcttggggctctggtttagcaaggacagcgaggatactttcctctctccctcctccttactcctctctactaaggattaaggagccacctcttcctccttaaggcctttgggagagatgggtctcctggtattagaaaggagagcagacgcctagagttctgacctcttgggcctcccctaaacaaaaagcatagccccttcactaccctagtaacaagtatgacctgttgcctgttgaggtcaggtgtacctgtgtgtctctctctgtgatgtatgtgggcttggtgtccacatcaatgtgcgtgaatactcctacccacagactgctactgtgccaatatagaggttcataagaaagataaaagagaaccagcagaaccccaggttctgcctctccttcctccctttgcccagataaaggtgtacagtgtttgtggtgaggctgctggacactgctgttttgggctttctagagagaatgcaaacatgcaaaaacagtgtggtagtgtaggcagaacaagatctagaatcagaagacctggagtcgaatctcagctccaacacccactggatgaacgtggacaagctgcttgatctctcagatcctcgatttcttcatctgtaagatggaaacaatatgtgtcttttctaaggggaaagatcaaatgacatcatgtatgtgaaaatgcttagaaatgggtgatgatgatgatgatgatactgattattagggtatctaataaagttggggaaagaacaaaatccccccctcacaccctattgcaccaccagccttctccctccctgctcaattatacccatgttatagggaaggaaatagggaagaaacttgtctaaggtcacatggatgttcgcaacaattgggatgcagaacttgatctgactcccaggccaggtttgattttgatttgcagtggcagagaggactaattttttactaggttctgagccctgtactgaactctggattgccctgtacttggtggtggtatacagttcagcagtttttagcatatacacgaatttgtgcagccataaccactatctaattctagaacatttttatcacccccaaaagaaatcatgtacccatttgcagtcacttgccattccctcttctccccagccctgggaaaccactgacctaccttatatctctatgaatttgcctaatctggacatttcatataaatgcaattgtacatgtggcctttgtttctggcttctttcacttagcatgttttcaaggttcatttgtgctgtagcatttatcagtactttgttcctttttctagctgagtaacgtgtgggtatatcacattttgtttattcatctgttgagggatgtttgggttgtttctactttttgactattgtgattagtgctgctatgaacattgatgtacagatttttgtgtagatatgttttcaattatcttggggcatcttttatttttaatgtcagttttctatttttaaaaaatctagacaggttggcaaatcatttctgtaaagagtcagtaaatattttagcctttgtggtccatgacattaggtatacagattacaatttctgaactctgccattccagtgtgagagcagccatagataatatgtaaacaaatgagcatggctatgttccaataaaacttttaaaaagcaggggacagattgggcctgtggaccatagtataccaacccttaatctaaatgacacattcacatgatacattattctaaaggcacaaaaagcaaaaattctccctcccacctctgtcttccagctacggggttaccttccttgaagcagttaatgttatgagattttgtgtctccttttagacacagttaataatgagcattaaagtggctatatactattccaatgtgttgcagatagtttagtcaacacaaaagaacggacatatctgagggtacaccctaaaagtccttgaggaacagaaccctaaaagagagaacacctgcctaatctgactcctccatcagaataatcttttgaactcctgagatttgcccagtcattttggggccatgtctgatgaaagcttggtgatcccttttgggtcaaaaacaagctctgactgaagagatgcaagattttctcagatgatttgtgtgtcagtcagagttccgccagagaaacacaaccagtaggatatattctgtcttgtctgtcttcatatccatgtatctgtcatctacctagatttaatgcaaggaattggtttatgcagttgtaggggctggctaggcaaatccaaaatccacagggcaggccgtgtggaagggaggtctggaaactctcagacaagacctgacattgcagtccactggtggaatttctccttcttcagggaaacctcagctttcaacggagtggatcagacccaaccatattatccaggataatctcctttacataaagttaactgattgtagatgtaaattacatttacaagataccttcatagcaacacctaggtcagtttttgaataactgggtattatagcatagccaggtcaacacgtaaaattgatcaccacagtccatgtcttgttaacttggcacctgtacacatttccttaaaccatttaatctcccaataaagacaataacaaagtaaaacttctgcctatcatgacacagctaatctgtgtacaactgaaaatatgctcttttcctgggagagaattcacagtccttgactggtgttcacttttatccttgataatccagtaactttaataatattatgtaaatgtagctattttaataaattttatgttagatgacaaggggataagagagggaagaaaaaatacataaacacaaacattcataacaaaacaatgaatactcataataattatagtactaacttctgcaactgttcacatgatgtgttttataactaccggtgttacaaaattactgg

SEQ ID NO: 433481 - DNA, 7254 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 433482 - DNA, 5795 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaatgttcagtcttttatttaaagtcgagcggccgcgaatttagtagtagtaggcggctgc

SEQ ID NO: 433483 - DNA, 4742 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgttaagactgacctgggccggctcga

SEQ ID NO: 433484 - DNA, 4677 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgcggacagggttatcagcatactcgacaggatttttaccgactgctcatgtactcaatgatggatgctggcaggttgagtatacaggatcacctatcgttcggatatacatataaaactagtcaaatcgatacgcccagatggaataggcacactagc

SEQ ID NO: 433485 - DNA, 7311 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagaaacatgaatgaagattgaaaaagaattttgctgtgcagccttccatatttagaaagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 433486 - DNA, 3320 bp, Homo sapiens
tatgcagaaaaggcaaacagtaatagtcagcctcagtttatccttctagttgtttcccagatgcttccctctcttcctgcaatactatattaacatttacggggtgtggagctatgtattgtttctattttagtttttaaacttgcaaaattcatgataaagagtcatcgctgtgaccttggagactgacaatcttctatatgtttttttgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 433487 - DNA, 4824 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaggtggtctcttaagttgttttattaagttaatttgtcttactgaccatataatttagaacaaaaagcagctgtactaaagaggaaacttaggagtttattggggaaaacaaaggaatttgatcatttgaatcacgtggagtccaaatgaaattcagtttgacacctggcattttcatgtacccatcaatggcataaataatgttaaggtatgtgtataatactctgaagttttaaaacttaactttccaatggatttaagcaaaagaaaacccaggattttgtagatctacagaaactaggagggataactcattaattcgtgagagagcaaatatagaatattctgtcaataccttgtcttccttagttacttttctagaattcctcctacatcttcaattgaccagtcttgggccgcctctctgcgaaattgtcctcagatgcatcttgtgttcctgatagtcactttctatctcag

SEQ ID NO: 433488 - DNA, 3759 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtaaatggcaattttatatttaagtttctgtcatctactagtgtcaggaatt

SEQ ID NO: 433489 - DNA, 2140 bp, Homo sapiens
  misc_feature (20)..(20): n is a, c, g, or t
  misc_feature (22)..(22): n is a, c, g, or t
  misc_feature (42)..(42): n is a, c, g, or t
cggatccctcatcaggatcnanaactgatgtttcatagaccnatccctttttttgcttcctgcttctgcccgtccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 433490 - DNA, 1823 bp, Homo sapiens
catctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagttaggtctaccttggtagacctaacccaggtagacccaactagaagtgtgaaaacgtaggcttggattaaggcgacagagattcctaggatagtcagtagaat

SEQ ID NO: 433491 - DNA, 484 bp, Homo sapiens
gtacactttttaaatactatttgatcagtaactcatttgactgcattaaagattttgacgtgccattctcttgcttcctcttcctcaaaaaggataagcactgttcaaaggatgccctacttgcaggattaaaacaagatgaaccaggacaagcaggaagtcagaagtcttctaccaagtaaggaaaatgagtttacttcctgttgtacatacaaaaagaaactaggcaaaacacaagaaaatgaaacgcaacttagcatattaggagaccagaaacctgggttctagtccagctctgccatgaaccagcaatgtgaccctgttcaaattgcttagattctcttggcatcacttttccttttggctggacaatgtggtctgtaagttacctttcagctctaacactgattctgttttgtagactagtcagtcattggaagtaatgacagatgatatatgagaaatgctttgtaaactaaaagta

SEQ ID NO: 433492 - DNA, 665 bp, Homo sapiens
ggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatccttttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacacattcagactcggggatcctctaatcgactgcagctgcagttgccggcgccgtt

SEQ ID NO: 433493 - DNA, 2141 bp, Homo sapiens
ggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatccttttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacaccacttttaaaagcctgttttcaagtttttgaaaggcatttgttttctgttgtttgccaataatctgaaagtatcatgtgaaaggaattattttaaaagcattttaaacctttcccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaaaaaaactgtt

SEQ ID NO: 433494 - DNA, 1452 bp, Homo sapiens
agtcggtcgtcaagagacacctacactaatagtttatgcacagcataaactattcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaaaaaaactgtt

SEQ ID NO: 433495 - DNA, 1929 bp, Homo sapiens
acattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatc

SEQ ID NO: 433496 - DNA, 902 bp, Homo sapiens
cgacccacgcgtcgcccacgcgtcgtgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgccatataagtcaacggaaaatgagcccaggcttgctatgaagcagtgtgtgaatggacaatgttgaatgaatgtctggctcagtgatggagagccaggttcatctttgaaatctagggctcttcactcatgaagcagactcctagtcctggagtgactgtgtac

SEQ ID NO: 433497 - DNA, 427 bp, Homo sapiens
  misc_feature (31)..(31): n is a, c, g, or t
  misc_feature (39)..(39): n is a, c, g, or t
  misc_feature (48)..(48): n is a, c, g, or t
ggctgttcaggaggtccccattaggtccatngtccattnaggtccatngtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccacttatgacctaaatgaacgggatcgctctagaatgctc

SEQ ID NO: 433498 - DNA, 781 bp, Homo sapiens
acagccaaaagagggaaacaacttggctgggcgcagtggctcacgcctgtaatcccaagcactttgggaggccaaggcgggccggatcacctgaggttgggagttgggaaaccagcactaccaacatggagaaaccccgtctctactaaaaatacaaaattagccaggcatggtggcgcatgcctgtgatcccagctacctgggaggctgaggcaggagaatcacttgaacccatgattttaaaaatattttcctttaatttttttgtagactatgagaagacaacgaaatgaagttgtagttgaattaaggaaggtgagtctgattaatattgggtacttctaagcataattctaacaacattatagcattatatacaagatgccaaatatatattatgtttttaggtaaaatgtataacctattgtataactaaattttatttactaaatttagttaaactttttaaaatctcaactgctaagcatttttctttagaaaaaggagagattttgactaaatttgacaggcttttgaagttgaaaggatacaactagttacttgttcattatgcaaaaacagatataaagaacttaaagtataagtcattgagatacagttgtattaaatagttctgctattaatgggcagtagtaagtccctgaaaagaacttgttgcaaacttcttcaacttttaagtattatagttgagaatatatttataaatttgctccaagcattttaagtgaagttgaaatggcccttgatttttgtaagacat

SEQ ID NO: 433499 - DNA, 758 bp, Homo sapiens
acattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggaggacaacttctccgttgaaaaaaacacccccggcgtgagaggccatcctggtgatcctaacagtgccttccagcggcctgtgttttactctggatatagctgattcaagatgtggctcacggtgtgccctcttccaggcaaaggataccccttatttcagcttgtccacaaatctctttaccccctcctgagaggagaccaccagctgcattcttacatataaagtctaaagggttatacaaagctgtcatcctctagtctacagtatcctttccctccacctgctggtggtggtagtgggggatggggtgggctagggaatggcaccatcacgtttgattatttaaaaaggaaaaaaaaagcttcattgtcttagatacagctgctcccgagattgtctacataaggtgtatgggttaaatacacacatgcaca

SEQ ID NO: 433500 - DNA, 2394 bp, Homo sapiens
acattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgccatataagtcaacggaaaatgagcccaggcttgctatgaagcagtgtgtgaatggacaatgttgaatgaatgtctggctcagtgatggagagccaggttcatctttgaaatctagggctcttcactcatgaagcagactcctagtcctggagtgactgtgtac

SEQ ID NO: 433501 - DNA, 1823 bp, Homo sapiens
  misc_feature (31)..(31): n is a, c, g, or t
  misc_feature (39)..(39): n is a, c, g, or t
  misc_feature (48)..(48): n is a, c, g, or t
ggctgttcaggaggtccccattaggtccatngtccattnaggtccatngtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgccatataagtcaacggaaaatgagcccaggcttgctatgaagcagtgtgtgaatggacaatgttgaatgaatgtctggctcagtgatggagagccaggttcatctttgaaatctagggctcttcactcatgaagcagactcctagtcctggagtgactgtgtac

SEQ ID NO: 433502 - DNA, 1444 bp, Homo sapiens
acattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataaggggattttggcccaagcagcttctttttgagtgccaagtcgacgcggccgga

SEQ ID NO: 433503 - DNA, 2322 bp, Homo sapiens
acattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgccatataagtcaacggaaaatgagcccaggcttgctatgaagcagtgtgtgaatggacaatgttgaatgaatgtctggctcagtgatggagagccaggttcatctttgaaatctagggctcttcactcatgaagcagactcctagtcctggagtgactgtgtac

SEQ ID NO: 433504 - DNA, 1948 bp, Homo sapiens
accgcccttttttataatatatcccagcggccttgtaccaacttccccacatcttctaaaactgaacccttctgtggtacatggcagatgaatgaaaccaaatggttcccctgaatgcctctgaaccagcctagggtctttcatcaatatcatctgaagagaagaactgatcatgatctcatagccatttgtagatgtcttcattttcatgattttgaattgttcaattttctccaccctcccacattcttctataagattgcctatgtttctgcctcatcttcagccatttttaatatatttacttagtccatcgagtactacttgcacacttgtgcatcttttacagtcagcaagttgcaaaaaggtgggataacattttgttgataaggtaaccacttgatctttccttccactaattgttaagttacttatggcccaagcagcttctttttgagtgccaaatcccccttatccaaaaggtgtattatcattggtacaagattggcatcaattactgcctgtacctgctgctgatttcctgcagtgatgttggagaggaaccacactgcttctttattaattttctctttgggatgtgtccaggagtgctgggaagtgtgaaagagcatcacagttcaaaactacttgtgtttgctcatcagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgccatataagtcaacggaaaatgagcccaggcttgctatgaagcagtgtgtgaatggacaatgttgaatgaatgtctggctcagtgatggagagccaggttcatctttgaaatctagggctcttcactcatgaagcagactcctagtcctggagtgactgtgtac

SEQ ID NO: 433505 - DNA, 851 bp, Homo sapiens
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacggggtgagtactcttattgatttaacaaacaaatctaatgttcttgcacgctattcaacttttaaaatccgttttcagttgaccctt

SEQ ID NO: 433506 - DNA, 6956 bp, Homo sapiens
  misc_feature (1649)..(1649): n is a, c, g, or t
  misc_feature (6956)..(6956): n is a, c, g, or t
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433507 - DNA, 6268 bp, Homo sapiens
  misc_feature (1649)..(1649): n is a, c, g, or t
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaa

SEQ ID NO: 433508 - DNA, 6738 bp, Homo sapiens
  misc_feature (1431)..(1431): n is a, c, g, or t
  misc_feature (6738)..(6738): n is a, c, g, or t
gcaattatggcattaaccttatgctgttactctaagaagttcaaaaatactgctctaagaagcaagaattaaaatgaaatgtgtttttttattataagagccaaagattcggatatggactcttatctcagagattgcttcaatatatagaagctatttagaagggggtcatgtaagccaaagacaaaacttgtattgctcaaaagaggaagagctttttacaaattcactaataactctttcataagaactgtaaccatttgctactttgaaatgaaaagggttcctcttataaactaatagaaactattgagcagaagtgattactgacacttaaaggtagaaaatggaaataagaatctggtaagttataggcatgtttgccagattccttgaattgtttggtcatttaaatgctgcgaggatgtatatatcaaaagggcttaggtctaaaatgattttcactagaaaaaccagtaagtcagtcttaagacttttctatggcaaatttataatttgaggcgtttctctcttttcccctcattttagcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433509 - DNA, 6670 bp, Homo sapiens
  misc_feature (1363)..(1363): n is a, c, g, or t
  misc_feature (6670)..(6670): n is a, c, g, or t
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433510 - DNA, 6246 bp, Homo sapiens
  misc_feature (939)..(939): n is a, c, g, or t
  misc_feature (6246)..(6246): n is a, c, g, or t
cttctgaacgtgtgaaattactaacgtaatgctcagccaagagtgtgttcttagagaggtctgacaggtatttctgacatttcaccatgttcactgtattatagtttgcttttcagaaatggcatatatttatttaagatataagttatcaagtctgttgttacagtttgtgttactagttattatctttctgtagcaaaatgaccaaaatacatgcattatacatattattattattatttcctctagaaatgaagaggtacctaaatcagaattgtggaaactgaggtgctcatattgtaacccacaaatgtgtaacaatgtcatttccactggactttagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433511 - DNA, 5027 bp, Homo sapiens
  misc_feature (1649)..(1649): n is a, c, g, or t
  misc_feature (5006)..(5006): n is a, c, g, or t
  misc_feature (5022)..(5022): n is a, c, g, or t
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaaggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagcctatttaatgtagtgatggttgcagatctgcaaagggctgctatagtgtaattgaaatatatcttgatctgtctatcaagtcatctttngagatagctgactatnatata

SEQ ID NO: 433512 - DNA, 5695 bp, Homo sapiens
  misc_feature (388)..(388): n is a, c, g, or t
  misc_feature (5695)..(5695): n is a, c, g, or t
agccagtttttaaaagccatttctcaagaactccgggagcattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433513 - DNA, 5768 bp, Homo sapiens
  misc_feature (461)..(461): n is a, c, g, or t
  misc_feature (5768)..(5768): n is a, c, g, or t
aactagcagtccctttggggccaattgatgtaattattttcagtgtaaatcctaaaggttgcctgttttaggttaggagatgatagtaaaaatacctaatgctctgtttttatacctcatactaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433514 - DNA, 2727 bp, Homo sapiens
  misc_feature (1649)..(1649): n is a, c, g, or t
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtagagatgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatcngctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttcccaccacctcgaactctgggaattcgtttaacacgacggccagtaccccgagactcagcactcgtctgatgcct

SEQ ID NO: 433515 - DNA, 2075 bp, Homo sapiens
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtgaggacagctggagagaggtccttcctgcttaccttcttgttaaaatgttcatttaaaaaagcttgttgtcattattatcattattattgagatagagaaattttaggattattttgatcagtggtatgtgaaatacaactcctgaatattaagttaaatcatctcattttaagcacttaattaaaaactagttgaaatgtgagcattgtctttatttgggaccaacaaattttgttctcaaattccattaaaaagaaagtaagaagtgtttgttatctgtttttagtgttgaatacactaaagtattgccttaatttgtattgattattgtcggtgaaattgtgcaatgtattctattggcctttgattggtataagccagaacattttttgcctactaaatagtttaaaatgtatcttgccccacatactttgtgctgcccttattactctatctttttctgccactaagtgtgccaagatcagtcatttgtctgcataaaagcatatgaaattgtaatgtattagcagtgatcccatactttatcacaagcttacgtgtaagaaagtaggccattgttttttaaagtcagtggtttgttagactataacctcctacatatttttttcttccttccttctgtccatctgtcataaatctttatgagcattcagatccaccataaatggtggtccatcttttttactttttctaaggaaataacatttccaaagaagttattctgaatctcatcattta

SEQ ID NO: 433516 - DNA, 1599 bp, Homo sapiens
cttacatagtggaggtggagatcctcctctccaaggaccacccgcgtagggcgagattccccaattctgacttttcactactatcccccacaggggcggggctccaactccaggtaaccagaccaggcaacctggacttccaattagcaggggagtccccaagccagcctggccaatctcggccggctagccaagacgaccagacgtgacgtcagacatgattaagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctacaggcaccagccgttcagaatctcctgtatgttctagtatcaaaatcttgaatcttactccctagaaacccggtttttggaattccagaggtttattgggaccccttttaaggaaatcaaagaagtccccgaaat

SEQ ID NO: 433517 - DNA, 1481 bp, Homo sapiens
  misc_feature (23)..(23): n is a, c, g, or t
  misc_feature (1481)..(1481): n is a, c, g, or t
aaggaataaaaatagactttgancaaaaaggaacatttgctggcctgggggggcatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggggccgatgatataaaaaccgccgaggagggacagcaaataataacaatacacaacacgtgatgagaagaaccgactgataaaagaacgcaatcactaaaaacgacgaacgacgccgtggccacaaaaaagcatcgcgcgtggaagaacaaccaaacgagttggcgctacagccaggagagacaacccccgatgcgggggcggaatagaaaaaaaccacccacaaacgcagtagaccgacgcaaaaacaaacacacccgacgcgtcagacaacaacaacaatgggcgggacaaaatgaagcacgttttcttcctcatactgaaccccgcgcgctctcatcatacacgcgccgcagtagatgaacgatacacaacatacgagcaaagagcagggcaacggatcagatgaccagacaagaaagaagaaaaatacacaggaacaaagaaaacaaaatccagcaacacaaaaaaggatgagcaggtagcagccaaaaacactagcaagaccagcacagaacaagcagacaagacagcatcacgacacagaacn

SEQ ID NO: 433518 - DNA, 317 bp, Homo sapiens
cttattactctatctttttctgccactaagtgtgccaagatcagtcatttgtctgcataaaagcatatgaaattgtaatgtattagcagtgatcccatactttatcacaagcttacgtgtaagaaagtaggccattgttttttaaagtcagtggtttgttagactataacctcctacatatttttttcttccttccttctgtccatctgtcataaatctttatgagcattcagatccaccataaatggtggtccatcttttttactttttctaaggaaataacatttccaaagaagttattctgaatctcatcattt

SEQ ID NO: 433519 - DNA, 283 bp, Homo sapiens
gttgttctggtttagtttttgtttgggttttttgtttgtttgttttttgcttaagcatgaagaaagcgtgtaatattacaaccctggtaatattaatagtaagtaaggttacttagttgtttaaccagccatgcatgtattgaatttatttaattttagtgcaaactggctcacttttctccttttccctcccctagaaacggcttttggattcagagtttattgatcctttaatgaataaaaaagcccgaatatctcacctgacgaacagagtaccaccaac

SEQ ID NO: 433520 - DNA, 418 bp, Homo sapiens
gtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaaggtgagcgggccggccggcaggctgggctcagagaggcagagcgcacccctcacggcctggccgcgcccgggtgcggggccggcggagccgtggctggcagctgctaccgtcagcgcccgcagcggccaggcagggcagggccgggcagggtggctgacgccgcggtcccgggctagcctgggcgttggggaagcgggcagtcgggcggcccctggcggc

SEQ ID NO: 433521 - DNA, 473 bp, Homo sapiens
ataagttatcaagtctgttgttacagtttgtgttactagttattatctttctgtagcaaaatgaccaaaatacatgcattatacatattatttccaagaaatgattttattaaaataatttctaattcaaattttagaccatttatttaaaatgctttctgtttgcatgccttcttaaagattgaaataaagtggcctttattattatttcctctagaaatgaagaggtacctaaatcagaattgtggaaactgaggtgctcatattgtaacccacaaatgtgtaacaatgtcatttccactggactttagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactgg

SEQ ID NO: 433522 - DNA, 675 bp, Homo sapiens
tttgctttacaaacagcactacagtgaataatcttgtatatgtgtcattcactggggagcaagtgtgtccataggataagtagaattgctgagtcgattttgcatttactattttgatagctgttgccacattgccttccataaagattgtttcaagttacattcccacagtcaatatttcctatactcttgctgaatgcatgttatctatttgtattgccacacacaaaagaagttgttctcttctgatttctaatatttaattttgtagaatgttcatgaagaagtcttacaagaatatcagaagataaagcaggtaggtatcatcactgttgattttctgacctgtggttgaaaaatgttgtaaattctgcaatctcattcctcttttttttttttttttttcatctgcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttcca

SEQ ID NO: 433523 - DNA, 287 bp, Homo sapiens
tctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccagcatcaggtcagatcactgaaattatatttatgtgaagttaagttcatatccaccttttggggatagcaggtactaatcatcacttctctaatgtgttgtgacgttcttcgcagtagtcgcatctgt

SEQ ID NO: 433524 - DNA, 1971 bp, Homo sapiens
tctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacaga

SEQ ID NO: 433525 - DNA, 2344 bp, Homo sapiens
tctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagaaaaaaaaacaaaaacacaaaaaaaaaaaaacaaaacaaaaacaaaacaaaaaaaaaaaaaaaaaaaaaacaaaaaaaaaaaaacaaaaaaacaaaaaaaaaaaaaaaaaaacaaaaaaagaaaaaacaaaagaaaaaaaacaacgagagagagcgccgaaagagaaaagaaaagagaaaacaacacagcgctatgaagggggacggcgagggcgaagacaaaagaagaagagacacgcagaccggatgaagaagtgcggagcgcgcgcgcagaacgacacggcgtgacaagtgaagtatggtgtcgtatacgaaaagcagagagaacaacgagaccgcggcgacgggacaaggagctgggtaggcaacacggc

SEQ ID NO: 433526 - DNA, 16390 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433527 - DNA, 10911 bp, Homo sapiens
cggcacgagggggtcccatctcttcggggctggtttggtttcactctggtccttctgggtctctttgttttcttttttctctgtttgtctctctgtttcttggtgctcgtctctgggcctcgctttgcttgtctctatctttctgtttctcattctctagctccctcagtttctgcttgggtctcctggtgtctcgctttctcccatttctttctctgtgtcctctctctgtgtcttgttttctgtctccccctttctctgtctgctccctagtgtctctctctgtctcctcccaccctgttctgggaccccacccctaacacccttctttctgtttctctccttcctgctccttcatctgcccacagagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433528 - DNA, 9660 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagagcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433529 - DNA, 1488 bp, Homo sapiens
ccgcccggtcttgcgcgcaaaagggtgacaaagccttcctgtgccgcagcctggcagcctacacggcggcctgtcaggcagctggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433530 - DNA, 949 bp, Homo sapiens
catgttgatctagaggatcccgttttggagcttcgtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433531 - DNA, 893 bp, Homo sapiens
  misc_feature (20)..(20): n is a, c, g, or t
  misc_feature (27)..(27): n is a, c, g, or t
  misc_feature (37)..(37): n is a, c, g, or t
  misc_feature (39)..(39): n is a, c, g, or t
  misc_feature (51)..(51): n is a, c, g, or t
  misc_feature (65)..(65): n is a, c, g, or t
cactacggtgtgtaagacgnggaccanaccaatgatngncatgactcccangagaagccagcganggagaaatggagagcgcaggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433532 - DNA, 16422 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgcaaaaaaaaaaaaataatcacaaaacaaccacaa

SEQ ID NO: 433533 - DNA, 16163 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactctggctctacagcgtctgcagtactgacgttcgccctccgtgaccctccgaa

SEQ ID NO: 433534 - DNA, 14281 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtctgggtggtactacggggagcttgtggggggtggggcccgtcgggatggggggcgggtttgtccttgggtgctgcacgcatatggctggggccttgctggatgcgcttaacagggggggtggcgcgaggggtgagggtgacagggg

SEQ ID NO: 433535 - DNA, 644 bp, Homo sapiens
cgaggatgtaagcaccatgaggatgtcagcaccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatggtgagggatgtagtatggaaaccaggcttcttggggcaaaggcacctggatcctcatgggatgagggcagtcagggtgggtgtttagtctgcaagcggaggtgctaaatgtctgtgtcttgcagttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433536 - DNA, 257 bp, Homo sapiens
cacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgaggtaggaacctagtcatctggggcagaatatggggcctcacccctcccactgctcatcagccccacggcctgtctacttggcctcttatttatttctttta

SEQ ID NO: 433537 - DNA, 16514 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgcgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggtgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtatcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgaggggcctggcttctgcggacccctggcatctggcacagggggccccttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcgacgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggacatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggtgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatggtgagggatgtagtatggaaaccaggcttcttggggcaaaggcacctggatcctcatgggatgagggcagtcagggtgggtgtttagtctgcaagcggaggtgctaaatgtctgtgtcttgcagttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgca

SEQ ID NO: 433538 - DNA, 4196 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagaatatagccaccctgacctggaagaggccagtgcttgtgtcctagcagagcctgtctgctgtaaacagcatgacaatttctcggcacctgggagccatccccacctgtgagccatcacggaccga

SEQ ID NO: 433539 - DNA, 223 bp, Homo sapiens
aacgaaaatactggttttgttttactgagaggcactgtgggtttttgttttgttttgctttgctttgtttagtttacagccgggaaatcccaatatggaccctaaggaactgcagaagacatccttagacggagagttactctcacgaaagagtaggggattctgaagccgatgatccccttgagctctaaactgccaagtcccgccctttctgtctcgtcac

SEQ ID NO: 433540 - DNA, 1610 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcaggtagaaggggcgtctccggggcttcacagggaacacaggggcttcggccaaccacaagtacgcagttgcacatgccctacttttgcccattctttgcaaatcccctaaggaacgaacgcgcctcggtgcgggcctttctaatcttcgcttgtcccttcacttccacagctggaggtcgaattcaccacgtcacgtagagaaaaggggcggtgtctcgggtctccccgtgtgggcatcaaggcgggctccctataggagctggtgtggacgtccgggcgtggggttagggcggatgcgggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433541 - DNA, 1442 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcagctggaggtcgaattcaccacgtcacgtagagaaaaggggcggtgtctcgggtctccccgtgtgggcatcaaggcgggctccctataggagctggtgtggacgtccgggcgtggggttagggcggatgcgggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433542 - DNA, 1160 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433543 - DNA, 1538 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcaggtagaaggggcgtctccggggcttcacagggaacacaggggcttcggccaaccacaagtacgcagttgcacatgccctacttttgcccattctttgcaaatcccctaaggaacgaacgcgcctcggtgcgggcctttctaatcttcgcttgtcccttcacttccacagctggaggtcgaattcaccacgtcacgtagagaaaaggggcggtgtctcgggtctccccgtgtgggcatcaaggcgggctccctataggagctggtgtggacgtccgggcgtggggttagggcggatgcgggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagactctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433544 - DNA, 1273 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433545 - DNA, 1499 bp, Homo sapiens
ggttctgagcgtgtctgtgtttaaccttgatttcagtcttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcaggtagaaggggcgtctccggggcttcacagggaacacaggggcttcggccaaccacaactggaggtcgaattcaccacgtcacgtagagaaaaggggcggtgtctcgggtctccccgtgtgggcatcaaggcgggctccctataggagctggtgtggacgtccgggcgtggggttagggcggatgcgggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatga

SEQ ID NO: 433546 - DNA, 391 bp, Homo sapiens
ccccaccgggaactggagaccagcgcgggacgagcgcgacttggccttagcgcgggccttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttgtaagtatctaccaatcgctgagagccacattaaagccccttatttgcatgccaggatctttaaagagagcaggctttcaaacgaaaatactggttt

SEQ ID NO: 433547 - DNA, 883 bp, Homo sapiens
tattgctgttgaaggcaaggatgggcctgtacaaagcagccttggaccaggagggaaaaccccaaggctctgcagcctccctgctcccctccgtttaaggctgtggtcagggagggatgggcagggtgccagccgcatggaggcagcagagacacccgtgttccagctggggcaaggggaactgatatgtgggctgtgggctgttccactaggcgtggccacctctgcacatgggccttggcacttaggaaatatgggtgctgctgcattgggaccttgtgtgggtgcagagcaggatggctgctgcgtggagggtaattttgtcccctggagagtgattggtgaccctcttccctgctgctgctgtttgcaggctcctggcctatactacctctgacgccctgatcctgagttcctctgccctcctctgctgccagcagcgctgttggtggcctcaccctcctccagtacccaggcaccaaagatggcaccaccatcctcctgcttgtaccacagggtgctgctccctgggccaactcctgtgaacttgctcacttcccatggagaccgaggccagggcctgcccctctgaggcccctgttttgtggtcctgctgcctctgctgtgctgcgttcaggaggttgtccactgctcgacgtgggtcaccatgcagcccttgctgttcccacaatttaacagaaaaggaaactgaacggatgagtaaggctgcccagggtcactcagctggaaaagagtagagctggactcaaacccgggactgtctgtctctggtgcctgagttgggaagacgctgttgatgtccccttctgcctcgctttgagcttcctcctccgtgggccctccccctactctagagaaacta

SEQ ID NO: 433548 - DNA, 924 bp, Homo sapiens
cgcgcgcgtgtagagagtgagtttgtttcgcctggaaaaaagaatagtcgcccgctagaagcgttgggaattatgttcttgcgccgaaccgacgggcgtcgaatcgtatgttgcgtgtggtgttgggccgcccagttgtcacatagtatgacggcgagtctactcgctcgaaagatctattgtggcggtcgctttgtttctggtatacagtctcgatctcgcgtggaggaggtcgggtgttgcgtcatcaactagtggtctagccggtctgtagatttattatatagaggtgcgcttcccctcgtcccggatagttatttctgcgttcgttgttgtgtcgctcctcgtgctgtttcttatagtgtcgctgcggccgtcggtcgccccggcggcctgtattagtgccgccccccctctcttcttttttttttttgttcttttttttttttgtgtctcttttgtttgttttttttttttttttgtttctttttttttttttttttttttttttttttttttttttttttttttttttttttttttttttttttttttttttttttgggaatgagaaaataactttatttcattgtgaggagcggagcttgctaggcatcaggaactcaagaaaggcttttaactactttatgatttgtgaaccacatgaatggattacctattcaaaacattaagaaagaaatattcagcactgaacaaccaagtcagagttcactgtgggcaaaggcagagatgaccaaggaagaaaggggccaggtgaacctgggcctcagggaaagcccctacagctcaggaagctttttggctgaggttctgttcctatcaatcatgatggcagaggagcccatgtaacccagatgatgttatgtggtatcagcagaccccatgacaccagtgctgctggct

SEQ ID NO: 433549 - DNA, 1385 bp, Homo sapiens
aactaaaaaaattattggccgggcgcagtggctcacgcctgtaatcccagcactttgggagttacaggcgtgagccatcgcgcccgaccagaagcattttcttttcaaagtgtgtgcacagagtgaggaggccagcctgggcaacttagtgagttgagacctgtctctacaaaaaaataattacgaaaattagccaggtgtgctggtgtgcacctgtagacgcagctacagactgaggcgggaggatcacttgagtccaggaagttgaggctgcagtgagctacaatggtgccactgcactccagtctgggtaacaagaccctgtctcaacaacaacgaaaagttgggagggaaagggagtagctccatgaactgacgctggacattcaggcatatccacatgagactcactgtgcacttgctcagtagctaagatgtctgccccacaaaatagaagccttcagttgctgctgctcaaactcctgcatcaaagacacaagagcttgcctaagtgaccacaacagttgcagccacacatcaccactggtcctcacttggaactggccaaggtaggggaggggccagcagctgtccaggcacctgcagaggctgctcagagctgggagaggcctgtgccactgctgtcagctacagagcctgatcttgagcatcctgtcgcagatagaaagtcaatcagaaaaatctggttgtgctcttggattagctgggcatttggggtaagggagggactgcagattctgatttgtacagaaaactaaaatttcagtatgttgcaataaaatgaaaatatgtcttactcaacaggagtgtgattgcaaaaacatcccccaattctgggttcacattttgtattctgatttctgggatggctcttcccacattagtaggagcgttccttgaatacacttgtctggtatcacatgagtagaaaaggagaaaaattatatagacacacatacacatgtgtgtacatgcataaatgatctctggaaggatacccaaggaacaaaccaatagtaggtattcatggagtgaggagcggagcttgctaggcatcaggaactcaagaaaggcttttaactactttatgatttgtgaaccacatgaatggattacctattcaaaacattaagaaagaaatattcagcactgaacaaccaagtcagagttcactgtgggcaaaggcagagatgaccaaggaagaaaggggccaggtgaacctgggcctcagggaaagcccctacagctcaggaagctttttggctgaggttctgttcctatcaatcatgatggcagaggagcccatgtaacccagatgatgttatgtggtatcagcagaccccatgacaccagtgctgctggct

SEQ ID NO: 433550 - DNA, 1279 bp, Homo sapiens
aactaaaaaaattattggccgggcgcagtggctcacgcctgtaatcccagcactttgggagttacaggcgtgagccatcgcgcccgaccagaagcattttcttttcaaagtgtgtgcacagagtgaggaggccagcctgggcaacttagtgagttgagacctgtctctacaaaaaaataattacgaaaattagccaggtgtgctggtgtgcacctgtagacgcagctacagactgaggcgggagggaaagggagtagctccatgaactgacgctggacattcaggcatatccacatgagactcactgtgcacttgctcagtagctaagatgtctgccccacaaaatagaagccttcagttgctgctgctcaaactcctgcatcaaagacacaagagcttgcctaagtgaccacaacagttgcagccacacatcaccactggtcctcacttggaactggccaaggtaggggaggggccagcagctgtccaggcacctgcagaggctgctcagagctgggagaggcctgtgccactgctgtcagctacagagcctgatcttgagcatcctgtcgcagatagaaagtcaatcagaaaaatctggttgtgctcttggattagctgggcatttggggtaagggagggactgcagattctgatttgtacagaaaactaaaatttcagtatgttgcaataaaatgaaaatatgtcttactcaacaggagtgtgattgcaaaaacatcccccaattctgggttcacattttgtattctgatttctgggatggctcttcccacattagtaggagcgttccttgaatacacttgtctggtatcacatgagtagaaaaggagaaaaattatatagacacacatacacatgtgtgtacatgcataaatgatctctggaaggatacccaaggaacaaaccaatagtaggtattcatggagtgaggagcggagcttgctaggcatcaggaactcaagaaaggcttttaactactttatgatttgtgaaccacatgaatggattacctattcaaaacattaagaaagaaatattcagcactgaacaaccaagtcagagttcactgtgggcaaaggcagagatgaccaaggaagaaaggggccaggtgaacctgggcctcagggaaagcccctacagctcaggaagctttttggctgaggttctgttcctatcaatcatgatggcagaggagcccatgtaacccagatgatgttatgtggtatcagcagaccccatgacaccagtgctgctggct

SEQ ID NO: 433551 - DNA, 1349 bp, Homo sapiens
tattgctgttgaaggcaaggatgggcctgtacaaagcagccttggaccaggagggaaaaccccaaggctctgcagcctccctgctcccctccgtttaaggctgtggtcagggagggatgggcagggtgccagccgcatggaggcagcagagacacccgtgttccagctggggcaaggggaactgatatgtgggctgtgggctgttccactaggcgtggccacctctgcacatgggccttggcacttaggaaatatgggtgctgctgcattgggaccttgtgtgggtgcagagcaggatggctgctgcgtggagggtaattttgtcccctggagagtgattggtgaccctcttccctgctgctgctgtttgcaggctcctggcctatactacctctgacgccctgatcctgagttcctctgccctcctctgctgccagcagcgctgttggtggcctcaccctcctccagtacccaggcaccaaagatggcaccaccatcctcctgcttgtaccacagggtgctgctccctgggccaactcctgtgaacttgctcacttcccatggagaccgaggctgctcagagctgggagaggcctgtgccactgctgtcagctacagagcctgatcttgagcatcctgtcgcagatagaaagtcaatcagaaaaatctggttgtgctcttggattagctgggcatttggggtaagggagggactgcagattctgatttgtacagaaaactaaaatttcagtatgttgcaataaaatgaaaatatgtcttactcaacaggagtgtgattgcaaaaacatcccccaattctgggttcacattttgtattctgatttctgggatggctcttcccacattagtaggagcgttccttgaatacacttgtctggtatcacatgagtagaaaaggagaaaaattatatagacacacatacacatgtgtgtacatgcataaatgatctctggaaggatacccaaggaacaaaccaatagtaggtattcatggagtgaggagcggagcttgctaggcatcaggaactcaagaaaggcttttaactactttatgatttgtgaaccacatgaatggattacctattcaaaacattaagaaagaaatattcagcactgaacaaccaagtcagagttcactgtgggcaaaggcagagatgaccaaggaagaaaggggccaggtgaacctgggcctcagggaaagcccctacagctcaggaagctttttggctgaggttctgttcctatcaatcatgatggcagaggagcccatgtaacccagatgatgttatgtggtatcagcagaccccatgacaccagtgctgctggct

SEQ ID NO: 433552 - DNA, 1708 bp, Homo sapiens
cttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttacagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagttaaaaaaaaaaaa

SEQ ID NO: 433553 - DNA, 374 bp, Homo sapiens
ttttggtaatcaaatatttcaaaaggtgagtctcctttggggtgattctctcacacagaaagatgattcttggaggaaacatatctaagcatcctccaaggtagtgtcagcattcaaagttgatcctgaattatctctgcagacactttttgtgttgggcattatgctgaagccatttgttgtagagcaagttgatttttatggctgagcttatctgaatttagtttgatatattgtattctttatttattcattcattgattcactgattcattcatttttcctgacattcaaacaaatgtttcttgaacacattgtgaaagggccaggcatttgtcaggtaatgagggtataatggtaaacaaggtagacac

SEQ ID NO: 433554 - DNA, 1847 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaagt

SEQ ID NO: 433555 - DNA, 994 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaataaactgctttttattcttgctgggagtcagtcttaacagcttcttatgggcaatcataagaggtactcaacaattgctacctgccggccattttacatatgattcatttatttaatccttacagcaacatgaatagatgatgtgccacactccattttttaaaaactaagttatatagagcttaatattcggctcagagtcacacagctgtaattagatttggatttcactcccatccatatttcttaattccatgctctactgcctccttggctaa

SEQ ID NO: 433556 - DNA, 1950 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttgacttttgtcgtcttcaacacactgcagcgtgtagcggttgagcctgtgtcacatagctgaatcagagtcatctgcggtactcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaagt

SEQ ID NO: 433557 - DNA, 1651 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttgacttttgtcgtcttcaacacactgcagcgtgtagcggttgagcctgtgtcacatagctgaatcagagtcatctgcggtactcagggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaagt

SEQ ID NO: 433558 - DNA, 1378 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaagggctggggcgacaccgagttctctaagcagtatgtgtctgtgagcaggcctgggaggctggccctttgcccttccgagaagatcgctgagcagcaagtggaagtggtgcatggtttctccaagcagagtggtgaatagacatcaagggacaattcctttctgtatcagcctattttgctaggagcctagatctaaagctttacgtgccccaaatctgggtgcccgacccagtttgtcaaagtgggatttcattttaatgatcaaccttgcagtcagaagtgtggtgtatgtcaaaagac

SEQ ID NO: 433559 - DNA, 1243 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttgtatgtaggcaccagagcagctgtgtcccaagggctcctgcaggactgtgaccgtgggacccccatgtgacttccacaggacacgtgactgtgtggtcctgtgcgactccagggctgtgtgtgaccatagggctgtgtataacctcagggatgtatgtgaccatggggccgtgtgtgaccgtggggccacgtatgactgtggggccgtgtatgaccatggggccgtgtgtgaccccagggctgtgtgtgaccccagggctgtgtgtgaccatggggccgtgtgtgatcatgtggccatatgtgaccctggggctatgtgtgaccccagggctgtgtgtgaccccagggctatgtgtgacctcagggctgtatgtaaccatggggccctgtgtgatcgtgtggccatatgtgcccctggggctgtgtgtgaccccagggccaggcatgacaccagggctgtgtgtgaccccagggctgtatgtgaccccagggctgtg

SEQ ID NO: 433560 - DNA, 1073 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttgtatgtaggcaccagagcagctgtgtcccaagggctcctgcaggactgtgaccgtgggacccccatgtgacttccacaggacacgtgactgtgtggtcctgtgcgactccagggctgtgtgtgaccatagggctgtgtataacctcagggatgtatgtgaccatggggccgtgtgtgaccgtggggccacgtatgactgtggggccgtgtatgaccatggggccgtgtgtgaccccagggctgtgtgtgaccccagggctgtgtgtgaccatggggccgtgtgtgatcatgtggccatatgtgaccctggggctatgtgtgaccccagggctgtgtgtgaccccagggctatgtgtgacctcagggctgtatgtaaccatggggccctgtgtgatcgtgtggccatatgtgcccctggggctgtgtgtgaccccagggccaggcatgacaccagggctgtgtgtgaccccagggctgtatgtgaccccagggctgtg

SEQ ID NO: 433561 - DNA, 1258 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccgaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaagt

SEQ ID NO: 433562 - DNA, 742 bp, Homo sapiens
gtccaccccatgggtggagtctcgctttttctttccagtgttggctgacttacagctcttataaactagtggcaatttctgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaataaactgctttttattcttgctggga

SEQ ID NO: 433563 - DNA, 3644 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433564 - DNA, 1441 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagct

SEQ ID NO: 433565 - DNA, 498 bp, Homo sapiens
tggtgatgggcctcaggtatacagcatcatatcttcctttcactatgaacattacaacgaagaccttgactgaagtagaaatggcttgactagaaattttttaatcttgctttatgtacttttccagagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtcagttcaaactttgggagggaagttcgctgttttaaaatgagatgtaggctgggcgtggtggctcacacctgtaatcccaacactttgggaggccgaggtgggcggatcacctgaggtcaggagtttgagaccagcctggccaacatggtgaaaccccgtctccaca

SEQ ID NO: 433566 - DNA, 565 bp, Homo sapiens
  misc_feature (10)..(10): n is a, c, g, or t
tgatagctgnctctagaggataccctcgtcttttgataggatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtatt

SEQ ID NO: 433567 - DNA, 654 bp, Homo sapiens
tgggattcttgtcccaggtaacaagtctcccagaagactcatatccttctgcaggatgcacagcaggagcttgtcaagttttaaagaatagcacttcatagttgtggtcccccagtttctagcatctaaacattttaggtttagtttatgccatctcttagtacacaatttgattttaagtgttattagtttatttttggtgtcagtcttttctgacagtctcatctcaattttgaaataaattattttcatcttatctgtcatactagccaaagagaattcctaccagatatctctttgcttgatttaacctggacgttctcaacttctcagcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtatt

SEQ ID NO: 433568 - DNA, 1031 bp, Homo sapiens
tgagactgaatcttagtcttttgcccaggctacagtgtagcggggtgacttctgctactgcaacctctgcctccaggttcaagcgattctcctgcctcagcctcccaagtaactgggattacaggcacctgccacaatgcctggctaatttttgtagttttagtagagacggggtttcaccatcttggccaggctggtcttgaactcctaacctcgtgatccacctgccttgacgtcccaaagtactggattataggcgtgagccaccatgcccggccccaaatatagatttaagttcatttctttgtctgtggatatctaaccgttcaacaccattttgttgaagagacactttaactttttaagcagttattttttcaaatacgcctgctgtagtttattagttgacaaaacatttgctaataattcttagataaggatttggtcaaaataaaggcactgcaaagactaatcatggaaaattatttatcgtgacgtacttctattgctgcaaagaggaaggccaatgtctcagccttatttaaatacataatgtacatgttaccctgaatctgctgataagcccaattttagtggtgactctcttccaaccatccccttcctcccatcagtcatggacatactatctaaaaaagaagaaaacacccttgttggtttgtttaactttgtctttcccacgtccttccagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcagggtttgtcttttttttttttttttttttttaaattg

SEQ ID NO: 433569 - DNA, 3893 bp, Homo sapiens
tgagactgaatcttagtcttttgcccaggctacagtgtagcggggtgacttctgctactgcaacctctgcctccaggttcaagcgattctcctgcctcagcctcccaagtaactgggattacaggcacctgccacaatgcctggctaatttttgtagttttagtagagacggggtttcaccatcttggccaggctggtcttgaactcctaacctcgtgatccacctgccttgacgtcccaaagtactggattataggcgtgagccaccatgcccggccccaaatatagatttaagttcatttctttgtctgtggatatctaaccgttcaacaccattttgttgaagagacactttaactttttaagcagttattttttcaaatacgcctgctgtagtttattagttgacaaaacatttgctaataattcttagataaggatttggtcaaaataaaggcactgcaaagactaatcatggaaaattatttatcgtgacgtacttctattgctgcaaagaggaaggccaatgtctcagccttatttaaatacataatgtacatgttaccctgaatctgctgataagcccaattttagtggtgactctcttccaaccatccccttcctcccatcagtcatggacatactatctaaaaaagaagaaaacacccttgttggtttgtttaactttgtctttcccacgtccttccagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433570 - DNA, 3155 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433571 - DNA, 2536 bp, Homo sapiens
tgggattcttgtcccaggtaacaagtctcccagaagactcatatccttctgcaggatgcacagcaggagcttgtcaagttttaaagaatagcacttcatagttgtggtcccccagtttctagcatctaaacattttaggtttagtttatgccatctcttagtacacaatttgattttaagtgttattagtttatttttggtgtcagtcttttctgacagtctcatctcaattttgaaataaattattttcatcttatctgtcatactagccaaagagaattcctaccagatatctctttgcttgatttaacctggacgttctcaacttctcagcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433572 - DNA, 3715 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacagattcaatgttcttatcaaactcccttgatgcaggtttgctacatcagcagttttttggccagagctgacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433573 - DNA, 2129 bp, Homo sapiens
tgatgagagcggaacacgttggtctaagttttctgtgacttgagtatcattctgctattaactccctaggagtattttatgctttcttgtggtccccaatcaatctgtaagttaagtgagttaagaaagttaaaaccagttttcttttgactcttttagcgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433574 - DNA, 1788 bp, Homo sapiens
ggcggctggcaagccggtcgcccccgatagcccgacaggctgactaccttcgccaagaatagcatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433575 - DNA, 5230 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggtggaagctggaacgcagtcccaagtgtcaatggcagaacacagatacctgaatccagttccacctttcctgtgtatcctcttccacttatcttacttccccttcatgttgaaccaacgttaataggtgcaaggcacgagatgagttcacaagcaatcagtgctggaaggatgtgcaaaataaaagttaagagaagctgaggatatagaaggcatcctgaaagtaaaacagctgaggaccacaaagcatatcatggaaaatctgttaagcaggggaggtcaggtaggagaggaaagaatagtccctcccaaaggaagcagttaaataagtctgtgggaggtcagtggtaaaaggaagtgggaatgaagtgaacagagagtgcagctaggccttcccctaggagatagctactgagtgtcttttaagccagactctattaacagggaagggaagtgggaggtccattggcctttgtgaactatgagcataaacacaaaccaagaatgacgataacttacagggttaaattctggttcttcaataattctattccctttaccaacaattgattcaaaaatagacatgtgacccaattttaggccacgagacaacaaactgggtggcttctggaaaacagcttcccaaaaaggtaagaccaagttcccttccatttcagccgcttaagttagcactttctgctaaatgcagctaaacgtgttctaactagttaaatggcacagaacaatggatctgtttacttgtaataaagtcaggaaagaaacatggaatatgtaaaagcacaggaaattcaaatcatgctatgacagccaaaccagtaaagtcttagagttaatgaggagaaagcctttagctgtacctccacagtggccataccctaggcagcattcccaataccaaacatacccctctcccagaactgctaagtctaagcccagaggagaaagggaaaggtagggtaattctctcctcaaggagaccaggggtccctggaccaagccatggggagggtgctaaatgatggacacaaagcctattcacagaacatcctgaggccttaggatgaactggatttcagcaaccttctctccccaacattctggcagtgctaaatgcttgctcaatgaaagtgaattttggcaagaagagtccccagaaacccaatatgttctggctggagaacaaaccttcctggaaatcccgtagctcagaaagccaatgtttccctgttcccctgcagggttggggcaggctctagaccacggcctctatcatgaatgcaccagtggtatcaaggccgatattctgaaaagtaactagcataccaggcttcaggagcttaccttccaggtctggggacagtgacaagcccaagctccaggaagactatcaaagggaaacaactgctattagggcagcaggagaaacaagcactggagagaggctgagtatgtgaataatcccacactgtgatcactcatgacctgctaaaagctctggcttgcctcatttgaagaaataatcaaattctgtcttgctgcaaacctattcttcctgattttctcagggactactccatccatactgaaataatgtttgacttcttcccaagagcaagttagttaacaagtttaagatttctcccccatacttacatgtccataccctcccttctgcccatattctttaattatttaatttttatttcttggagacagggtctcactctgtcacccaggctggagtgcagtggcccatcttagctcactgcagcctggacctcccaggctcaagcagtcctcacctcagctcccagctatttaaaaggctaaggtgggaggatcgcttgagcccaggagttcaaggctgcagtgaaccacgattacgccactggactccagcctgggcggcaacagaacaagaccctatctcaaaaaaaccaaaaagatagttgtgcaataattaaagaaaaaaaaaaaaacagtaaaataagagcaaataaaatcctgtttgcttcgatat

SEQ ID NO: 433576 - DNA, 5575 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggtggaagctggaacgcagtcccaagtgtcaatggcagaacacagatacctgaatccagttccacctttcctgtgtatcctcttccacttatcttacttccccttcatgttgaaccaacgttaataggtgcaaggtaaggaggactgggttgaagctgctagtaaaggcttccttttcagactagaagctagtaggacagaaacaggtaccatgcaaagagcaaagccattagctggtgattggcaaatggcgccagaaggaaataagggagtattgctaagagtatcagcagaagctagacatacaggttttagcaaaagtattttggtaaacacaaggactagaggaagcgggagggtgggggggggggatgaaggcaaaagacacattaatgcagtcttcaaggagctaagaccttgatataggatgagggcagagaggaagggatgtctttggagaaacttttgatgtcttgcaggcacgagatgagttcacaagcaatcagtgctggaaggatgtgcaaaataaaagttaagagaagctgaggatatagaaggcatcctgaaagtaaaacagctgaggaccacaaagcatatcatggaaaatctgttaagcaggggaggtcaggtaggagaggaaagaatagtccctcccaaaggaagcagttaaataagtctgtgggaggtcagtggtaaaaggaagtgggaatgaagtgaacagagagtgcagctaggccttcccctaggagatagctactgagtgtcttttaagccagactctattaacagggaagggaagtgggaggtccattggcctttgtgaactatgagcataaacacaaaccaagaatgacgataacttacagggttaaattctggttcttcaataattctattccctttaccaacaattgattcaaaaatagacatgtgacccaattttaggccacgagacaacaaactgggtggcttctggaaaacagcttcccaaaaaggtaagaccaagttcccttccatttcagccgcttaagttagcactttctgctaaatgcagctaaacgtgttctaactagttaaatggcacagaacaatggatctgtttacttgtaataaagtcaggaaagaaacatggaatatgtaaaagcacaggaaattcaaatcatgctatgacagccaaaccagtaaagtcttagagttaatgaggagaaagcctttagctgtacctccacagtggccataccctaggcagcattcccaataccaaacatacccctctcccagaactgctaagtctaagcccagaggagaaagggaaaggtagggtaattctctcctcaaggagaccaggggtccctggaccaagccatggggagggtgctaaatgatggacacaaagcctattcacagaacatcctgaggccttaggatgaactggatttcagcaaccttctctccccaacattctggcagtgctaaatgcttgctcaatgaaagtgaattttggcaagaagagtccccagaaacccaatatgttctggctggagaacaaaccttcctggaaatcccgtagctcagaaagccaatgtttccctgttcccctgcagggttggggcaggctctagaccacggcctctatcatgaatgcaccagtggtatcaaggccgatattctgaaaagtaactagcataccaggcttcaggagcttaccttccaggtctggggacagtgacaagcccaagctccaggaagactatcaaagggaaacaactgctattagggcagcaggagaaacaagcactggagagaggctgagtatgtgaataatcccacactgtgatcactcatgacctgctaaaagctctggcttgcctcatttgaagaaataatcaaattctgtcttgctgcaaacctattcttcctgattttctcagggactactccatccatactgaaataatgtttgacttcttcccaagagcaagttagttaacaagtttaagatttctcccccatacttacatgtccataccctcccttctgcccatattctttaattatttaatttttatttcttggagacagggtctcactctgtcacccaggctggagtgcagtggcccatcttagctcactgcagcctggacctcccaggctcaagcagtcctcacctcagctcccagctatttaaaaggctaaggtgggaggatcgcttgagcccaggagttcaaggctgcagtgaaccacgattacgccactggactccagcctgggcggcaacagaacaagaccctatctcaaaaaaaccaaaaagatagttgtgcaataattaaagaaaaaaaaaaaaacagtaaaataagagcaaataaaatcctgtttgcttcgatat

SEQ ID NO: 433577 - DNA, 3447 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagaccctta

SEQ ID NO: 433578 - DNA, 2961 bp, Homo sapiens
ctgtatcacattccttagctcacaattgttttattattcaccttaactattagtatatacatagcacttacggataaagattctacagaatacagtacagttctgagtcccctttcctaactggaggtttttcagtcctgctatgaggtgatacttatttcccatgctactcaagttaatttaccagagttctagatatttgtccattcaggaccattttaggactccatgctaaagggtcagataatgaggtaaaggtcaaggtggttggatttttgactacaagggtagtagagtcttgggcagcctaagtcttgaccgtttgttagggaataatgactataagcctggaactgcccaccctgccgtgtacttgcaggaatacaagaaagcaggtcacctttcaagaaaacctggctttatggattatgcatgaagtcagtctcttcctggtacttttctttcagcctcattagtaatccccttcccccatgctattcactccatgtgattcctcagcttcagaaatagaccctctgtttagaatttttggcaaatgctttctggtttccacaggtggaagctggaacgcagtcccaagtgtcaatggcagaacacagatacctgaatccagttccacctttcctgtgtatcctcttccacttatcttacttccccttcatgttgaaccaacgttaataggtgcaaggtaaggaggactgggttgaagctgctagtaaaggcttccttttcagactagaagctagtaggacagaaacaggtaccatgcaaagagcaaagccattagctggtgattggcaaatggcgccagaaggaaataagggagtattgctaagagtatcagcagaagctagacatacaggttttagcaaaagtattttggtaaacacaaggactagaggaagcgggagggtgggggggggggatgaaggcaaaagacacattaatgcagtcttcaaggagctaagaccttgatataggatgagggcagagaggaagggatgtctttggagaaacttttgatgtcttgcaggcacgagatgagttcacaagcaatcagtgctggaaggatgtgcaaaataaaagttaagagaagctgaggatatagaaggcatcctgaaagtaaaacagctgaggaccacaaagcatatcatggaaaatctgttaagcaggggaggtcaggtaggagaggaaagaatagtccctcccaaaggaagcagttaaataagtctgtgggaggtcagtggtaaaaggaagtgggaatgaagtgaacagagagtgcagctaggccttcccctaggagatagctactgagtgtcttttaagccagactctattaacagggaagggaagtgggaggtccattggcctttgtgaactatgagcataaacacaaaccaagaatgacgataacttacagggttaaattctggttcttcaataattctattccctttaccaacaattgattcaaaaatagacatgtgacccaattttaggccacgagacaacaaactgggtggcttctggaaaacagcttcccaaaaaggtaagaccaagttcccttccatttcagccgcttaagttagcactttctgctaaatgcagctaaacgtgttctaactagttaaatggcacagaacaatggatctgtttacttgtaataaagtcaggaaagaaacatggaatatgtaaaagcacaggaaattcaaatcatgctatgacagccaaaccagtaaagtcttagagttaatgaggagaaagcctttagctgtacctccacagtggccataccctaggcagcattcccaataccaaacatacccctctcccagaactgctaagtctaagcccagaggagaaagggaaaggtagggtaattctctcctcaaggagaccaggggtccctggaccaagccatggggagggtgctaaatgatggacacaaagcctattcacagaacatcctgaggccttaggatgaactggatttcagcaaccttctctccccaacattctggcagtgctaaatgcttgctcaatgaaagtgaattttggcaagaagagtccccagaaacccaatatgttctggctggagaacaaaccttcctggaaatcccgtagctcagaaagccaatgtttccctgttcccctgcagggttggggcaggctctagaccacggcctctatcatgaatgcaccagtggtatcaaggccgatattctgaaaagtaactagcataccaggcttcaggagcttaccttccaggtctggggacagtgacaagcccaagctccaggaagactatcaaagggaaacaactgctattagggcagcaggagaaacaagcactggagagaggctgagtatgtgaataatcccacactgtgatcactcatgacctgctaaaagctctggcttgcctcatttgaagaaataatcaaattctgtcttgctgcaaacctattcttcctgattttctcagggactactccatccatactgaaataatgtttgacttcttcccaagagcaagttagttaacaagtttaagatttctcccccatacttacatgtccataccctcccttctgcccatattctttaattatttaatttttatttcttggagacagggtctcactctgtcacccaggctggagtgcagtggcccatcttagctcactgcagcctggacctcccaggctcaagcagtcctcacctcagctcccagctatttaaaaggctaaggtgggaggatcgcttgagcccaggagttcaaggctgcagtgaaccacgattacgccactggactccagcctgggcggcaacagaacaagaccctatctcaaaaaaaccaaaaagatagttgtgcaataattaaagaaaaaaaaaaaaacagtaaaataagagcaaataaaatcctgtttgcttcgatat

SEQ ID NO: 433579 - DNA, 1762 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtatt

SEQ ID NO: 433580 - DNA, 3655 bp, Homo sapiens
gagcggggcgggtagccggcgggctggctggcggggaccgagccgccgggccggggaggacggctgcgggcctgcgctagctccagcttgaagcgcccgggccgggagattcggcctccctcctccctgcggccggccgcccctcagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433581 - DNA, 3024 bp, Homo sapiens
tggtgatgggcctcaggtatacagcatcatatcttcctttcactatgaacattacaacgaagaccttgactgaagtagaaatggcttgactagaaattttttaatcttgctttatgtacttttccagagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433582 - DNA, 2447 bp, Homo sapiens
  misc_feature (10)..(10): n is a, c, g, or t
tgatagctgnctctagaggataccctcgtcttttgataggatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433583 - DNA, 2085 bp, Homo sapiens
  misc_feature (28)..(28): n is a, c, g, or t
agtaaactcggcaaatcggattgtcgantgtggttacggcactcaaggtctcttctaggtgttctgccatgaagggagttgaattcttcacttgctggtcaccttcaagcccttccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433584 - DNA, 1989 bp, Homo sapiens
  misc_feature (28)..(28): n is a, c, g, or t
agtaaactcggcaaatcggattgtcgantgtggttacggcactcaaggtctcttctaggtgttctgccatgaagggagttgaattcttcacttgctggtcaccttcaagcccttcagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433585 - DNA, 3590 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagacaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaaaaaaaaaaaaa

SEQ ID NO: 433586 - DNA, 5176 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggtggaagctggaacgcagtcccaagtgtcaatggcagaacacagatacctgaatccagttccacctttcctgtgtatcctcttccacttatcttacttccccttcatgttgaaccaacgttaataggtgcaaggcacgagatgagttcacaagcaatcagtgctggaaggatgtgcaaaataaaagttaagagaagctgaggatatagaaggcatcctgaaagtaaaacagctgaggaccacaaagcatatcatggaaaatctgttaagcaggggaggtcaggtaggagaggaaagaatagtccctcccaaaggaagcagttaaataagtctgtgggaggtcagtggtaaaaggaagtgggaatgaagtgaacagagagtgcagctaggccttcccctaggagatagctactgagtgtcttttaagccagactctattaacagggaagggaagtgggaggtccattggcctttgtgaactatgagcataaacacaaaccaagaatgacgataacttacagggttaaattctggttcttcaataattctattccctttaccaacaattgattcaaaaatagacatgtgacccaattttaggccacgagacaacaaactgggtggcttctggaaaacagcttcccaaaaaggtaagaccaagttcccttccatttcagccgcttaagttagcactttctgctaaatgcagctaaacgtgttctaactagttaaatggcacagaacaatggatctgtttacttgtaataaagtcaggaaagaaacatggaatatgtagttaatgaggagaaagcctttagctgtacctccacagtggccataccctaggcagcattcccaataccaaacatacccctctcccagaactgctaagtctaagcccagaggagaaagggaaaggtagggtaattctctcctcaaggagaccaggggtccctggaccaagccatggggagggtgctaaatgatggacacaaagcctattcacagaacatcctgaggccttaggatgaactggatttcagcaaccttctctccccaacattctggcagtgctaaatgcttgctcaatgaaagtgaattttggcaagaagagtccccagaaacccaatatgttctggctggagaacaaaccttcctggaaatcccgtagctcagaaagccaatgtttccctgttcccctgcagggttggggcaggctctagaccacggcctctatcatgaatgcaccagtggtatcaaggccgatattctgaaaagtaactagcataccaggcttcaggagcttaccttccaggtctggggacagtgacaagcccaagctccaggaagactatcaaagggaaacaactgctattagggcagcaggagaaacaagcactggagagaggctgagtatgtgaataatcccacactgtgatcactcatgacctgctaaaagctctggcttgcctcatttgaagaaataatcaaattctgtcttgctgcaaacctattcttcctgattttctcagggactactccatccatactgaaataatgtttgacttcttcccaagagcaagttagttaacaagtttaagatttctcccccatacttacatgtccataccctcccttctgcccatattctttaattatttaatttttatttcttggagacagggtctcactctgtcacccaggctggagtgcagtggcccatcttagctcactgcagcctggacctcccaggctcaagcagtcctcacctcagctcccagctatttaaaaggctaaggtgggaggatcgcttgagcccaggagttcaaggctgcagtgaaccacgattacgccactggactccagcctgggcggcaacagaacaagaccctatctcaaaaaaaccaaaaagatagttgtgcaataattaaagaaaaaaaaaaaaacagtaaaataagagcaaataaaatcctgtttgcttcgatat

SEQ ID NO: 433587 - DNA, 3065 bp, Homo sapiens
aagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggtaaattactaatcctgctcatgtggagatttacggataagtttttctgaaactaataaattacttatctgcagtataattctgttgtacatactgtggtatgttcagtatgtggtagaaattccatcccaatccaaatcaatagaagaaatagatttaatagcggaaatatgattaaattctactgcaaggcatagggctttcattctatatggttttatttccgttcttgatttataaattactttttttccttgagtttgctaattagccatatggaagggatgctgctcgcctaatttacctcacaagattgttatgagtaaatatattttaaaatcttaggatgtttctaccagttaaaccattcatctttacaaatgaaactagcatagctccttattcctttccccacagattcaatgttcttatcaaactcccttgatgcaggtttgctacatcagcagttttttggccagagctgacaggtttgttgatcagagctgttaacaagtagagtactgagttcactcttctctttttcgatagttgcaacaaatggtaaaatgaaattaatcataagttagggagaaaagggaaaggagtggcaatattattttattgtaaaataaaacagacaaaactatataaaacaaatgtgtagcttattataaggcaaacttccttgttaactactcagagggcctccatgtgccctgtgccagtaataccccttttcctcctcagaactctccactgtccagcctttaaaagtaatcactaccttaattaaaaataatttatcaccaaaatgcacatccctgaacactatagtttagtctacctttaaaatactcggtacttaatgttttgatgtgattcttaaagttactaccacagtgcctcagtgttttg

SEQ ID NO: 433588 - DNA, 1258 bp, Homo sapiens
ggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433589 - DNA, 541 bp, Homo sapiens
ggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttggtaggtccccaggtgggggcagccaggccacctgctcaccttgctggcatctgctcgcatcgcctgggacaggtgcccaccaccttgcacacttggctctcaaggagctgccgagttcctggccctcatcacccagacatgcagtccaggaagtggcaccccccctccccccaccctgcact

SEQ ID NO: 433590 - DNA, 1336 bp, Homo sapiens
ggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccaaaaaaaaaaaatctataatcacctgcccttcttttacttcttctcacctggtaaaacctttgaacaataaaaaaaaaa

SEQ ID NO: 433591 - DNA, 1232 bp, Homo sapiens
actagattaaggcacgcaaagggctcagtgcatttgcccaaacctggcctttggttgacgtccatagcttcaattcgtataaggaaaatatgggggctacagaaggtggggtcatagaccgtggggttgcccaagccaggggcgctgttgtccatgtttcagcaaaacagatgtatttttctctgggcgacaaaactcatcctaaatgcgactgagagccctgtaatgtcccaggacagcttgaccgctggggtgggtccccttccactgtcccaggctggggcgctgcgtctgggctgcccttggcaccatccactcctctctcgcccacagtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433592 - DNA, 755 bp, Homo sapiens
  misc_feature (11)..(11): n is a, c, g, or t
  misc_feature (36)..(36): n is a, c, g, or t
agagtcttacntctgtcggttggacgtgcagtgacngcgatctcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433593 - DNA, 634 bp, Homo sapiens
ggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgcctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433594 - DNA, 307 bp, Homo sapiens
gtgagctgggagatggggcgcgaggcctgcagtcctggggttgctcgctgttggaggctcttgcagtgtggtgagtccctggccggccagccttggacaccttcctaggccatgggcatcctcgtccacacctacaaggccaatgcctggccactgccttgaggccagccctgccactggtgctggccacctggggtcctgtggtcacagtgtttagatggaatgtgtgtaggagccaccatttgaacatcctggagaactcacttaaacgtaagatttctatacattcagaatgtctgtccgataa

SEQ ID NO: 433595 - DNA, 177 bp, Homo sapiens
gtaagaccttccccccaccgctgcatgatcttgccaggccctgtcctttcggggcgccgcggctccccgggcacctgtgtgcgccgcgtccgcactgcagagtgttgggggacgtcccgctctaggccaagtccttcccgccccatcagggtcagaacgatgcccccgggagctcca

SEQ ID NO: 433596 - DNA, 694 bp, Homo sapiens
  misc_feature (25)..(25): n is a, c, g, or t
cataacgctaggtacgaggctgggntcgtcactccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433597 - DNA, 1832 bp, Homo sapiens
ggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccaaaaagaaaacaaaaacaaacaagagagagaaaaagggaaaaaggcaaaggaactaaacggcagggaacactacctgcaatcgaacaaaagaacaaacaggagacgccgccgtacccagaactagcagagaccagcgcaaacagacagcccacagggcgggcagccacagctgagtgcgctcagcccaatggacacgaagaccggacccaaagtagacggccagccccacagtgggagatgtacgggcacatcaagtggcacctatcgcggctcaaataaagaagaaggcctaaccgattcgttactcctataagaatagaattctcccagaaggtgagcaccgcatcccccttggaatatgagaatacctcaggcgccaatccacacagaaagacattcacccctggtccgattaggctactaacggaaacaagtgcgaagacttgaaagaacccaaatactcgaaccgattattcggtaaccgaagagggacgagtgaacatactgccagggacacccaataatacagatgtaatcctgtacttgaatccattgcctcaaacaatgaactagt

SEQ ID NO: 433598 - DNA, 958 bp, Homo sapiens
tcctggggtgctgctgtcctggtgtgctgctgtcctggtggtgctgctcatcttccttgtcaagtacgaccttaacaacccggacaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgctgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433599 - DNA, 664 bp, Homo sapiens
tcgtgctggtgcttggccgcagtcagagcaagggctggtccggggacatggtgcagatgaggccagcctgggctctggcagtctgggtagtgccatgtgcaggcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtctaaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctcca

SEQ ID NO: 433600 - DNA, 555 bp, Homo sapiens
gtttaagagttctctgacacagtatcttctctttgggggacaacgtctagctttcaaggtgtctccaaacttacaggtgttgaccccgtgtggtgaatcacgcctgtaatcccagcactttgggagactgaggtgggtggatcacaaggtcaagagatcgagaccatcctggccaacatggtgaaaccccgtctctactaaaaatacaaaaattagctgggcgtggtggtgcacacctgtagtcccaactactcaggaggctgaggcaggagaatctgttgaacccggaaggcagaggttgcagtgagtggagattgcgccactgtactccaacctggcgacagagctagactctgtccccccaaaaaaaaaaaggaattagaaaatgatgacactattggctaaaataacaaagtttaaagaggaagataatggtgttgcagcagatgaacaatttgggataatttgctttctctcctaagcctccaactctatgccacttgttgttaaattgcttcccctgagtctgtgaataggtttgtaacaaccaatttg

SEQ ID NO: 433601 - DNA, 1166 bp, Homo sapiens
ctggaatctgtatctctgtgcccagggaagcatgcttttctgggaggaccccaaaagaaggcttacagtttcagcctgctttgcagtcagggcctgaggtatggtacagaaggtagtagcatgctggtattactgaacagtgctgggcctaggggctgatctggcccagatgactcagtaggcacccttaggaatcaggggttggccaccaatactgatcttctcacaggcctacacctcacagaagagctgggtttgtttcattctagtcctatgctttggacctccactcatttgggtatcacccctgttggaagaggaggatctggtgctagaaaatataaacccggggacccaggcaaggctgtgttgtgtggggaggaagaccaggtggctctctagtccctgaattaagggagcctgctgcctatgtgcggattcccacacagcagcctgtttttagtaactaatgcctatagttttgagaacttgctgtttttaggacactgctgggcattgacaatgtggaggttatgaacaagatctccaagggctgatgggcttcatggatgagatggttcttgaactggatccatgaggatgggtgagacagggctgtgaaattagggaaagcttccggggcaggtggaacagcatgaggcttccaacctgcatcagtagaaaatgacactggccaggtgtggtgaatcacgcctgtaatcccagcactttgggagactgaggtgggtggatcacaaggtcaagagatcgagaccatcctggccaacatggtgaaaccccgtctctactaaaaatacaaaaattagctgggcgtggtggtgcacacctgtagtcccaactactcaggaggctgaggcaggagaatctgttgaacccggaaggcagaggttgcagtgagtggagattgcgccactgtactccaacctggcgacagagctagactctgtccccccaaaaaaaaaaaggaattagaaaatgatgacactattggctaaaataacaaagtttaaagaggaagataatggtgttgcagcagatgaacaatttgggataatttgctttctctcctaagcctccaactctatgccacttgttgttaaattgcttcccctgagtctgtgaataggtttgtaacaaccaatttg

SEQ ID NO: 433602 - DNA, 820 bp, Homo sapiens
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 433603 - DNA, 946 bp, Homo sapiens
  misc_feature (572)..(576): n is a, c, g, or t
  misc_feature (578)..(578): n is a, c, g, or t
  misc_feature (598)..(598): n is a, c, g, or t
  misc_feature (600)..(600): n is a, c, g, or t
  misc_feature (606)..(606): n is a, c, g, or t
  misc_feature (612)..(612): n is a, c, g, or t
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctaaaaaaaaaaaaaaaaaaaaaaaaaaaaaaaaaannnnnanaaaaaaaaaaaaaaaaaaananaaaaanaaacanaaaaaaacaaaaaaaaaaaaaaatcaaacaaacaggaaaaaagttacctttaaacgtgtcaagagctcaaaaaagatctcacggaaactttcgcgcgatcctttaaccaaacgacgttcagaaaccccgcattccccggctcgaaaaactctaacacggcaaccctagataccctttcaacaaaacgctagtacattggatcattcatggacacagcctgaaacactacttggacaaccttaacttttgaaaaaaaacgtggctcctatccgactgcgcatctgggtccaatccttcttgtatccatacattctcccacatcggtgctatacct

SEQ ID NO: 433604 - DNA, 281 bp, Homo sapiens
gcggccgcctactactactactactgctcgaattcaagcttctaacgatgtacgggcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 433605 - DNA, 732 bp, Homo sapiens
tcattcagcctagcgggcgtggagtctgggttagtcattgccctgctctgagctgggactccttgtctgtactgggggtgggaggagggtgaataccacctttttagtggagcctggcccagaggagattggtgtcatgggggagggaaattaggttggtctttcaggcatcttctaaaggcagccacctgccgttcgcgacaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 433606 - DNA, 1338 bp, Homo sapiens
  misc_feature (855)..(859): n is a, c, g, or t
  misc_feature (861)..(861): n is a, c, g, or t
  misc_feature (881)..(881): n is a, c, g, or t
  misc_feature (883)..(883): n is a, c, g, or t
  misc_feature (889)..(889): n is a, c, g, or t
  misc_feature (895)..(895): n is a, c, g, or t
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcaaaaaaaaaaaaaaaaaaaaaaaaaaaaaaaaaaannnnnanaaaaaaaaaaaaaaaaaaananaaaaanaaacanaaaaaaacaaaaaaaaaaaaaagggggggggagagcatagcaatacaacccctcagggggggcccacatctgtgaacccaccacaaggttcttacaacacagcgagtggcacccaaactggggcgggcgcacacgaactcgatgacacggcagggcggacacaatacaccacccgtccagagcaaacaggagcacaacaaccgccaccctcgccgagccgctccctcgagcgaaccacacacccccctcccccgcgtgccggccgcccaccaactgggacgcacccacccatccccaagcagggaactatacagacgatacgagtgcacattcacagacgccccagcgcgcactgtggggcaaaaaaacgcgaaccaggcgggaagaagacaagcacacgacgcgcaacacccccaagcaaccatccgccgcgcgcgccccca

SEQ ID NO: 433607 - DNA, 537 bp, Homo sapiens
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccct

SEQ ID NO: 433608 - DNA, 504 bp, Homo sapiens
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccct

SEQ ID NO: 433609 - DNA, 844 bp, Homo sapiens
gttgatcactcggtgtacatcctggaggactctattgtggacccacagaatcagaccatgactaccttcacctggaacatcaaccacgcccggctgatggtggtgaaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcagttggccccaaaaaaaaaagaaat

SEQ ID NO: 433610 - DNA, 881 bp, Homo sapiens
  misc_feature (875)..(878): n is a, c, g, or t
  misc_feature (880)..(881): n is a, c, g, or t
actatttagaaaagacatttctacatattttatatatctatgaatattgcatctctaatctaatctaaaaatgttgttttgagacaattcttctgtgatgcttcctcctcatgctcataaatgtttaaagtcttgggatttcattttcaggctgaaatagataacaagaaaaaaatttaagtttaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaaggtagtatttttgtactattattggaagcatgccttccctttttcacattattaaattgtatttatatttgtgcaattttaaactatgttttcaaataaactttgtctgcggcttcgaggtcttttcaggaatctttcaaaatgggatttggggatcagaactccttctgatcaaatggaatccaatttgtactactggctaaaggtccttttattaaatattgaatatcactacatatgattttgcatgagctatctggaaatcaggaatgcatttttggatataaaacaaaactttaaaaatcttcctcctttgttaattttttaagactaaaatattatttaacctgaaattgaattttgtgattctttttagaataaaaatattaaaataaannnnann

SEQ ID NO: 433611 - DNA, 998 bp, Homo sapiens
  misc_feature (536)..(536): n is a, c, g, or t
  misc_feature (998)..(998): n is a, c, g, or t
tacatttcagacacactaaaacggacatccaagtgtatttctactgtctccgttatgaggtacagcgcctctgcttttgggtttgcatttgatgccatcctggacgtcctgtcatcggcgattgtcctgtggcgttacagcaacgcggccgctgtgcactctgcccatagggagtacattgccttcagcctgcattagctgacaagtcagcagtttctactacagaaagcaaaaaaaaagtaagagaagaagtctgagaagtcaaaagacttgcagattatctgactaggacactctgtggaggactttgatacaaatggattgatttttcagtctagtgatctctgttcagttgctgagacaaaggaaaacccactcccttggaggagcatgaccttttcctgtaattcttcctactgctgttgttgagctccttggatcctggctcctggacaccatcatcaagaagactttatggatgggctgtccacccactgagagaagaggagcatcagctacagtttctctctagattngccttcttcatttgagtaatgactgtcagcagggtcagattaaacacaaaacaatggacaattgcttggaggactaaactataagggcactaacatgtcaatagtaggctaaccacatccatggaaaatatatttaccagctcttctctcaaggaggattccgtgtggggtggaagtaatgattgtaaattccttaggggtagaaagtagggcataatcagaatattggaggatatgtgtgactcaggctcgtttcttcctaggattttaaacggtctagctgatggttgaccagaggtgtggggacatgattctgtggttggcctaaagtagctgcttaataatgacgttcgggtgggaccttccggtttctgcccaggtgaaaaaaggaaattctatggcgaaggctagggataaaaaagcggggtcgtaaacatctgtgtttttgtgatttttttcctn

SEQ ID NO: 433612 - DNA, 925 bp, Homo sapiens
  misc_feature (478)..(478): n is a, c, g, or t
  misc_feature (490)..(490): n is a, c, g, or t
gcgtgaagaaagtgtctgtttctcctttgccttccgccaggattgtaggtttcctgaggcctccccagcctttcagaactgtgcgtccggttatgaggtacagcgcctctgctttgggtttgcatttgatgccatcctggacgtcctgtcatcggcgattgtcctgtggcgttacagcaacgcggccgctgtgcactctgcccatagggagtacattgccttcagcctgcattagctgacaagtcagcagtttctactacagaaagcaaaaaaaaagtaagagaagaagtctgagaagtcaaaagacttgcagattatctgactaggacactctgtggaggactttgatacaaatggattgatttttcagtctagtgatctctgttcagaaggcccttgcaagacaccagtaccttgatatttgacttccagtctccagaacttggaacctgaacagtctgctgaagcacctgatgtnggccttcctgantgtcatgtaatacgtattcattttttccagctgaaaataaatagaattggaaaaaaaagaaattatgtaacgtgagaggaaaaagcctttgaagtgaactcttctggaagttttatgttcattgctatcctttagctttcccaaaatgcccataagccaaagatttcatgtgttatttctgtaatttggtagttttcatttaaattatgcattaaaaatgaatattcatcctaaaaaaaaaaaaaaaaaaatccaaacgaggttcttcttctcttttcccctcgggccgaattgggcggaggttggaacacagggccgcgggcaccatggcctactgggggtttccccgcgggttaagcccgggttgacagaatcggggggggaaacacaaaaagacggttgctcccaacacagaagggggtgcgacaggcgcaa

SEQ ID NO: 433613 - DNA, 859 bp, Homo sapiens
gcgtgaagaaagtgtctgtttctcctttgccttccgccaggattgtaggtttcctgaggcctccccagcctttcagaactgtctccgttatgaggtacagcgcctctgcttttgggtttgcatttgatgccatcctggacgtcctgtcatcggcgattgtcctgtggcgttacagcaacgcggccgctgtgcactctgcccatagggagtacattgccttcagcctgcattagctgacaagtcagcagtttctactacagaaagcaaaaaaaaagtaagagaagaagtctgagaagtcaaaagacttgcagattatctgactaggacactctgtggaggactttgatacaaatggattgatttttcagtctagtgatctctgttcaggttcaagtggattctggagtgcagtggcgtgcaccatgactcattgtcacctcaacttcccaggttcaacgtggatactcccacctcagcctcccaagcagctgggagtacaggcatgcaccatccacacctggctactactctcggctctctactaacgctccctatgctcttactcaagcagcctacgcatccttcgccaatatgcctcatactcagtccccacaacacttctcaactgggcctgcccgtaactatgcccaatagcttagacatatgccttgtcagatactaacgcaattccacttaccccattaacatatagtgaactctacctacataacctccatatcctaacctttcatccccaatgcacagaattgtctccattcgtgacacaccataccaactagtcaactctccatgtttctcctttctacgaccctaattacggccataacatcccttaaca

SEQ ID NO: 433614 - DNA, 789 bp, Homo sapiens
ttgtcattgggaggcgccgaagtggagaggtcggctcggaaggaaaagatcactcactcttgggggcatccagcagccatgttgtgaggacactcaagcagctgtgaagaggtgcacctggagaggaactgaggcctcccaccaaaaccaagcactgacatgccactcatggacacagggtccttgctttgtcacccagactggaatgcagtggctcactgccacctcaaactcctgcactcaaaggatcgtcccgcctcagcctcctgagtagctgggaatacaggaggaggttccaagatacccaaataggaacagctccagtctgcagctcccagcatgagcaacacagaagacagaaacaccaaggaaggctctggtctaaaccttgccctcactcctgtcttctggctcctgaccaccctggtgtcttcccctgtggccctgcaaggcatatcatgcttcctgtctctaggacctatccttgccattcagaggctggtctgtacaccagcagcactggcatcaccagggagcttgttagaactgcagaaaattggaccccactccagacctgaggaattaaaatctgcattttaccaagattgctaggtgattgttgtgtactttcaagttaagaagcctgtccttgagcagggctttcttgtgctttgctgtacattggaatcacttggagatctttcagaaacagttaagcctgggtcccaccccagagattctgagcaatttgtcaggggtgggtgggcttgaacatcaagatttttaaaa

SEQ ID NO: 433615 - DNA, 2019 bp, Homo sapiens
ttgtcattgggaggcgccgaagtggagaggtcggctcggaaggaaaagatcactcactcttgggggcatccagcagccatgttgtgaggacactcaagcagctgtgaagaggtgcacctggagaggaactgaggcctcccaccaaaaccaagcactgacatgccactcatggacacagggtccttgctttgtcacccagactggaatgcagtggctcactgccacctcaaactcctgcactcaaaggatcgtcccgcctcagcctcctgagtagctgggaatacaggaggaggttccaagatacccaaataggaacagctccagtctgcagctcccagcatgagcaacacagaagacagaaacaccaaggaaggctctggtctaaaccttgccctcactcctgtcttctggctcctgaccaccctggtgtcttcccctgtggccctgcaaggcatatcatgcttcctgtctctaggacctgcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatgacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctgagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggcaaaaaaaaaaaa

SEQ ID NO: 433616 - DNA, 1909 bp, Homo sapiens
agcggggcatttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctgagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggcaaaaaaaaaaaa

SEQ ID NO: 433617 - DNA, 1812 bp, Homo sapiens
agcggggcatttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaagagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctgagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggcaaaaaaaaaaaa

SEQ ID NO: 433618 - DNA, 696 bp, Homo sapiens
  misc_feature (249)..(249): n is a, c, g, or t
  misc_feature (261)..(261): n is a, c, g, or t
gcgtgaagaaagtgtctgtttctcctttgccttccgccaggattgtaggtttcctgaggcctccccagcctttcagaactgtctccgttatgaggtacagcgcctctgcttttgggtttgcatttgatgccatcctggacgtcctgtcatcggcgattgtcctgtggcgttacagcaacgcggccgctgtgcactctgcccatagggagtacattggaacctgaacagtctgctgaagcacctgatgtnggccttcctgantgtcatgtaatacgtattcattttttccagctgaaaataaatagaattggaaaaaaaagaaattatgtaacgtgagaggaaaaagcctttgaagtgaactcttctggaagttttatgttcattgctatcctttagctttcccaaaatgcccataagccaaagatttcatgtgttatttctgtaatttggtagttttcatttaaattatgcattaaaaatgaatattcatcctaaaaaaaaaaaaaaaaaaatccaaacgaggttcttcttctcttttcccctcgggccgaattgggcggaggttggaacacagggccgcgggcaccatggcctactgggggtttccccgcgggttaagcccgggttgacagaatcggggggggaaacacaaaaagacggttgctcccaacacagaagggggtgcgacaggcgcaa

SEQ ID NO: 433619 - DNA, 934 bp, Homo sapiens
aaggctaggtgggccgggtgtgtaaatcggccgaggcatcggcgattgtcctgtggcgttacagcaacgcggccgctgtgcactctgcccatagggagtacattgccttcagcctgcattagctgacaagtcagcagtttctactacagaaagcaaaaaaaaagtaagagaagaagtctgagaagtcaaaagacttgcagattatctgactaggacactctgtggaggactttgatacaaatggattgatttttcagtctagtgatctctgttcagctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgttgtgtctcaagaagctggaaacagagcagtcctcctcgccgtgccgtgaaggacaaaagcatggaggggctgaaggcgctgagcggaggtgatccgggctgtttgccaggtgtgggtggacctcgggaggcagcccgcccccgcggctgcttcaggccaggaccaccgttgaacaccccagaacaccccacttcagggaaattcaaggtcttcaccctcccctccccccgggtggaggggacgggaacctttgggcacctaggcccttgggaggccacggacaaacagactccggtgtctccaggcaggacttcttactcctggttactagatccatctgggccttgaccggggggttggacccggtccggggagtctggaatg

SEQ ID NO: 433620 - DNA, 524 bp, Homo sapiens
gcgtgaagaaagtgtctgtttctcctttgccttccgccaggattgtaggtttcctgaggcctccccagcctttcagaactgtctccgttatgaggtacagcgcctctgcttttgggtttgcatttgatgccatcctggacgtcctgtcatcggcgattgtcctgtggcgttacagcaacgcggccgctgtgcactctgcccatagggagtacattgccttcagcctgcattagctgacaagtcagcagtttctactacagaaagcaaaaaaaaagtaagagaagaagtctgagaagtcaaaagacttgcagattatctgactaggacactctgtggaggactttgatacaaatggattgatttttcagtctagtgatctctgttcaggtaaactggttatttttacttagactttgaggccattgtgttagagataaaaataatcctagatacttgacatttttatgtttgagtgattttgagtatttttacactttattttataaatgatctttttaagagct

SEQ ID NO: 433621 - DNA, 1865 bp, Homo sapiens
agcggggcatttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctgagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggcaaaaaaaaaaaa

SEQ ID NO: 433622 - DNA, 4381 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433623 - DNA, 2585 bp, Homo sapiens
ctggagacagccccgtggggccagccagcgctgggccaggagcggccacctggttcctgcgtgctacggccctgtgggcctgggagctgcctctgaggaacacgccgcaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaacctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433624 - DNA, 2954 bp, Homo sapiens
  misc_feature (45)..(45): n is a, c, g, or t
ttcggcggccccgactcgacccccccgggggaggacatctggaanaagtttgagctgcggcgggccgggcggcgggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaacctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433625 - DNA, 4702 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433626 - DNA, 5655 bp, Homo sapiens
ctcctgcctcagcttcctgagtagctgggattataagtacgagctaccatgcccagctaaattttttgtatttttagtagagatggggtttcaccatgttgaccaagctgatctcaaactcctggcttcaggtgatccgcccgccttgccctcccaaagtgctgggattacaggcatgagccatgaatctgtgctttagaacaggcaggctcacaaaggcctcactagcaagataacaacactggtgtgcgcacctggtgctcagggagaaatgccgggtaggcggagtcgtagacggatgtgggtctttgttgcaggaatgatttaggctgtgcttctagttgccttcacactctgccctctgtaatttcactcaaccagaacttgagggaagctgccgtccagtggcctcagtgctgaccgggaaagctgttatttgaaagctgacccacgtgagctcttcctggcacattccctgttccatttggaggaattccaggctctaacggagcctccctggggatcttgcgacaccacccttgatttgagggctaagtgagttagggagtaagaattgtagccacaattccccaagcaccggtgagcagggctgaggctcatcccactgtggacgtgggcttcttgatccggttcttggaggaagtggctcatctgtggctgcccatccacagtgatggccattgtggggggatgtccatccagagggcagcaggcttcctgtctccctctttcagagtccactctacgctgagtgtggaggcaggattctcacatcacttgcctgtgccttacacgtgcaccgagcctcctagttcagctgcggtgaacgaaggctcactgccccagacgagaggggggaggctcgcagcatcccagagacaaggcttcacctgatagaaatggaaacagataccagctcatgatgcggggcggggcttgcacatgggcatttcagacccaccttgctgctggcccataccccctgcggcctgcacggcccccgaccatatggtctccctctcacagaggggaatatggaggcgtggagaggtcagataacttgaccacggttgccgctggtgggtggtggagctgggcttgacctctcacagcccgggtggtcaggccgtgggctgctgtgtgtagccagcactgtgggcaccccagggcaggtgggtgtcttccatggtctccctggacctggtcagtgcagggctcagccgacctgggaccacacaggcttccctgcctccctgcccctcttctggagccctcgggtgactgggcctggactccacaggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433627 - DNA, 4668 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaaggtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433628 - DNA, 3249 bp, Homo sapiens
agcaggctgtacggccgagatgtaaggatgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433629 - DNA, 797 bp, Homo sapiens
gtgggtgctgcgggaagcctgaccccacctgcctgtgtggcaggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433630 - DNA, 4465 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtgagtgatgagggatgcaggagggcctctgcacatgttcactctccatccatccatccgtccattgatgatgatgatagatgatctttccatcatctatccatttacctgttcatccttccttccatccatccatccttccatcatctacccattcacctatgggtccttccatccatccatcatccatccatccatccttccattatccatccattcacctgttcatccatccatccatccatcatccatccatccatccttccattatccatccattcacctgttcgtcccgaactgagaca

SEQ ID NO: 433631 - DNA, 939 bp, Homo sapiens
tctgtgggttgcctggagccctggtgcccaggagcgcgtgggctgcatgccttttgggctctcctggttaaaaacagtgagcaaaggcaggtggctatatgtaggcacagagctgggccatccaagtccgactttgccaaagcctcacggtagatgggggcaggccttattagttctgctttgtagatgggaaagtgagtctgggagctgggaagggactggccagaactgcccaggtgaccgcagtgcctggaggcgagccaggtgctgccggggtctgcatgcctgccccggggagccacgtcctcacacctgcccccttggcctgcaccccaggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433632 - DNA, 465 bp, Homo sapiens
caaggatgcagatataatgatgataaaattgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433633 - DNA, 2837 bp, Homo sapiens
  misc_feature (45)..(45): n is a, c, g, or t
ttcggcggccccgactcgacccccccgggggaggacatctggaanaagtttgagctgcggcgggccgggcggcgggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaacctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433634 - DNA, 5037 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433635 - DNA, 4740 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433636 - DNA, 4886 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433637 - DNA, 1410 bp, Homo sapiens
atctagaggatacccactctgaccgattcctgcgagtcatacactgcgatgatgctccgcctttacccgttcagttgggagcttattgtgagattggatcatttccttttgagtgttcttctctttggtacaaaacctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433638 - DNA, 2295 bp, Homo sapiens
gcctcacctgcagctgcgcctccttgcacctgcgcctgtgctttttctcccagcactgcggacgcgactcgagggtgacgctcgctccgctcgtcccgctcgtcatggcctacccgggatacggaggaggggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcggtcatctcaaccccagcagaagcagttacatgcattctgggctgttcttcctacctggtggcttttgtcatctgacctctgcctgccccgagtcttcactcctggccttcacctgtccccttaaatgtgaccacagcagccacctgtggcttctctcccacagaagacagagccagttgtgtcacctgcttccctggggcagggtttcaaggtctcacatcccacatgtggcccacttggctctcctggagcatcctgacctggtggggtaaccatggccctggccaccccacccacagggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcactctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctcgtgtcgccggtggctcattttctggcaaatggaggcacgaacgcaggggccaaatagcaataaatgggttttgttttttaaaaaaaaaaa

SEQ ID NO: 433639 - DNA, 4320 bp, Homo sapiens
ctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgagagacctggagcgtttggcgccttcagaggagccaggcctttgcttggtctcccctaatcctgggaacctgctgtgttgcagacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccgggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccagacttcccactacctcaggcaagcgctggcctccctgaccccgggcacaggccaggcgctgtgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggtgagctggcctgtgggctgatgtgggtgggccccag

SEQ ID NO: 433640 - DNA, 546 bp, Homo sapiens
atgattgtgtagagtcatcttctctctgttggccttggggttcaggggggcctcggtccagcagcactgggtgctcctccggggccacgcgcagctcgttgtagaaggtgtggtgccagatcttctccatgtcgtcccagttggtgacgatgccatgctctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttag

SEQ ID NO: 433641 - DNA, 265 bp, Homo sapiens
caaccgcaaggcggagctgcggctgtgcaacaagctggtggcactgctggccacgctggaggagccccaggagggcttggagtttgcccacatggccctagcactcagcatcactctgggtaagccccctgagcccctgccctgccaggacccacactttgccagagctcagcctccaggtctgcagggcaggagccgaaacagctgccggattttcctggtctcctgtccaggcaggcacatctgcccagctggctcccccgtc

SEQ ID NO: 433642 - DNA, 575 bp, Homo sapiens
ggggtggaagggaccacatccagcaggctgaggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctgagtcctgtgggcgtga

SEQ ID NO: 433643 - DNA, 953 bp, Homo sapiens
ggcggtcgcctgtgatcgcagctactcgggaggtggaggttgcagtgagccaagatcgcgccattgcactccagcctgggcaactccgtctaaaaaaaataagaaaagaaagaaaaaaaagaaagagaccatcccaggaagttgtggggttggggaggcctagggttaggcaagaccttgaggcaggggttgaagccagggagtggtcagccagcactgtccctgcctgtccccatcccacagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtgagtggtgcctgaatctctggaaaaggaaacagaactagaggtccaaacttctaggttcgatgggaggagagggttccagagaagtgggtgaggatgtgttctgggattatgaggaagaaggggctgaggtccctgattccagtctgaaatctccctttcaggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctgagtcctgtgggcgtga

SEQ ID NO: 433644 - DNA, 732 bp, Homo sapiens
gtggccataggcggcctgaaatagagcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtgagtggtgcctgaatctctggaaaaggaaacagaactagaggtccaaacttctaggttcgatgggaggagagggttccagagaagtgggtgaggatgtgttctgggattatgaggaagaaggggctgaggtccctgattccagtctgaaatctccctttcaggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctgagtcctgtgggcgtga

SEQ ID NO: 433645 - DNA, 789 bp, Homo sapiens
ggcggtcgcctgtgatcgcagctactcgggaggtggaggttgcagtgagccaagatcgcgccattgcactccagcctgggcaactccgtctaaaaaaaataagaaaagaaagaaaaaaaagaaagagaccatcccaggaagttgtggggttggggaggcctagggttaggcaagaccttgaggcaggggttgaagccagggagtggtcagccagcactgtccctgcctgtccccatcccacagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctgagtcctgtgggcgtga

SEQ ID NO: 433646 - DNA, 896 bp, Homo sapiens
ggcggtcgcctgtgatcgcagctactcgggaggtggaggttgcagtgagccaagatcgcgccattgcactccagcctgggcaactccgtctaaaaaaaataagaaaagaaagaaaaaaaagaaagagaccatcccaggaagttgtggggttggggaggcctagggttaggcaagaccttgaggcaggggttgaagccagggagtggtcagccagcactgtccctgcctgtccccatcccacagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagccccccaccaccccccccccccccccaaaactttggggggggcccgtccccacattcgccctataggaggccgacttaaattaactggccgtgttttaacaacctcgggactgaaaaaacctggcgttacc

SEQ ID NO: 433647 - DNA, 712 bp, Homo sapiens
ggcggtcgcctgtgatcgcagctactcgggaggtggaggttgcagtgagccaagatcgcgccattgcactccagcctgggcaactccgtctaaaaaaaataagaaaagaaagaaaaaaaagaaagagaccatcccaggaagttgtggggttggggaggcctagggttaggcaagaccttgaggcaggggttgaagccagggagtggtcagccagcactgtccctgcctgtccccatcccacagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctgagtcttactctgtctcccaggctggagtgcagtgaaaccatcacagttcactgcagcctcaacctcatgggctgaatcgatcctccccgctcagcctccctggtagctgggactacaggcatgcgccaccatgcccagctatttcctgtaatttttttgtagagacagggtttcc

SEQ ID NO: 433648 - DNA, 4312 bp, Homo sapiens
  misc_feature (1725)..(1725): n is a, c, g, or t
agcggagagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactnatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcaattttcccgtctcatt

SEQ ID NO: 433649 - DNA, 4190 bp, Homo sapiens
  misc_feature (1725)..(1725): n is a, c, g, or t
agcggagagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactnatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggagggatgagcaggggatactctagagtcagc

SEQ ID NO: 433650 - DNA, 3272 bp, Homo sapiens
  misc_feature (685)..(685): n is a, c, g, or t
atgtccagtttagacgggccctgacagcagcagcctcttccacatcaagtgaagtgtgattgttaacgatcattgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactnatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcaattttcccgtctcatt

SEQ ID NO: 433651 - DNA, 869 bp, Homo sapiens
ttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtggtgaggtgcagcccagcgctgcttctctcttcctcctcttacgcaatatttgaaggggatacaaaattcctccgccgggttccacgaaaacgcaggtttttcctaatgcattgaggctgtcgctttttgaggtggtccagtcgggaattttcagggtatcgcattcgcctccttgctagcagcgggctagatctgcatttccccgtctgcgtttgtgacggggaagaagtgcttgaatagaatttgacaactgtttaaaccttcgtctgtcctaaatatcttcctcttccttggtttgcaacgtcaaaggcaaatccttaagcagtttataaaccacccttcttcacactgtcgttctcccatagggcccggcagaggataaatatttttaggagagctcgggaaaagcaggctctggttcctgggaatgcagccaccttagaagcagaagcaggcaagggcagtctcgcaatgtccccaggctgtggagcgctccgttcccggagacagcaggcagggctctccatccaagcacttgaggaaccatagggatctctcgtttcacccgaggcagatctcagct

SEQ ID NO: 433652 - DNA, 853 bp, Homo sapiens
  misc_feature (838)..(838): n is a, c, g, or t
gcacactacggagtggtgacattccgttctcaagaaatagaagaaagcgggtctactaacccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtatctggcctcgttggcctcagcggtggagctctgcggccggancaccccccatctccc

SEQ ID NO: 433653 - DNA, 1046 bp, Homo sapiens
ctcctagttctggcacctgtactatattatcgattttaagattttaaatggatgaataggaatcacctaattcatgacaggagctgtgatgaaatgtgaagaatgccatgttaactgatatctcgaagtccacatatggtagaattagcaacatcagagggaagaacgtctgtgaaccaagttagagtgtttactgtaccagtggagacttgttgaatctttattagctatatgcaacaaaactatacatacttttaaaaatttatgtttgagaaaaaaattgtttgctacttttcagaaaaaacaaggagagaaatgacagccaaaggttctacaggaatggaaattctgctgtcaacattagaggtaaatcagtgacacgctttaattatgtaactactaatgccaagcaatactgaagaagaaaaagcgtatgtgtgtgtataaatacacacagaaacacatacacacgtacatatatacacacacacgtatatgtaataatttttgttttagaggtaaagccagtaaatggaaattcattttaggtttttaaaatactatttggaatggtggtataaatattttaatatgtattaggtgactattgaagtatatttcccttatatgattataatgataactgtaaattgtaatcctaacatgccattctagttggtatagaaaataaagcattagctggaaataaatctttagcttaaaacaaatgaaaattatcgtttattgttttagctgatatacatttgtgattttactacacatattggttaactatattatattgatgataattgaatttctacgccagtgtaaagtttttggtggaccagcaggatgtattcagaatcaggattctgtattttgttcagttgcaatgttaagaacaagaaatgaattcatgttcttcaataggaagtcttagcatcataaagatgtcatttctccctagattgctctgttactttagagcaatctcaataaaagttaccaacagttttttttttctctcttttcttttctttttt

SEQ ID NO: 433654 - DNA, 7124 bp, Homo sapiens
  misc_feature (5794)..(5794): n is a, c, g, or t
  misc_feature (6229)..(6229): n is a, c, g, or t
acgttgcccgggatgcggacaggttccgccgcctccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433655 - DNA, 7265 bp, Homo sapiens
  misc_feature (5935)..(5935): n is a, c, g, or t
  misc_feature (6370)..(6370): n is a, c, g, or t
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433656 - DNA, 7297 bp, Homo sapiens
  misc_feature (5967)..(5967): n is a, c, g, or t
  misc_feature (6402)..(6402): n is a, c, g, or t
ctcctagttctggcacctgtactatattatcgattttaagattttaaatggatgaataggaatcacctaattcatgacaggagctgtgatgaaatgtgaagaatgccatgttaactgatatctcgaagtccacatatggtagaattagcaacatcagagggaagaacgtctgtgaaccaagttagagtgtttactgtaccagtggagacttgttgaatctttattagctatatgcaacaaaactatacatacttttaaaaatttatgtttgagaaaaaaattgtttgctacttttcagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433657 - DNA, 4379 bp, Homo sapiens
  misc_feature (4364)..(4364): n is a, c, g, or t
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagaggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtatctggcctcgttggcctcagcggtggagctctgcggccggancaccccccatctccc

SEQ ID NO: 433658 - DNA, 3993 bp, Homo sapiens
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagaggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactaggaaccttggcagctctgaacttcagtttttgcctccaatcctttgaaattgctgaaagctctgatgacttctctgcctctaacagctgcccttgcttggcctgggttccactggactttgccccacgcacctttttttctttgctgattttgctttgtatcctttcactgtaataagtcataactgaattcaactgtgtgctgagtcctgtgagtcttcctagcaaatcactaaccctatggtggtcttgggacccctgataagcatgttcattctgaatttctgtaaaggttggttatcccagaggttctaatgttctactgagaatgatcagagacagatggtattatgatccttttatggatgtgtgcagctgaggctgaaagagagaaatttacctgaggcca

SEQ ID NO: 433659 - DNA, 3715 bp, Homo sapiens
  misc_feature (2385)..(2385): n is a, c, g, or t
  misc_feature (2820)..(2820): n is a, c, g, or t
cttgatagttagtcctttgtatctctatataacccgcgcgggagagaagctcgctagtccccccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433660 - DNA, 700 bp, Homo sapiens
acagttcttcctcttccagtgtggcccagggaaacaaaaagattagacaacccgatttacacatcttttgaaaaaattcccagcatatagcacagtatgtggcacatgactgtcattgaaacaaatagggggtcaattataaagggatgaagtgagtcattgaaatttataataaatagaaaacaggatgtttcattcaggctatcgcaacataagacattatttttaaaaactgagaacattagtaaaattcacctttacagtgctttccaaattttgaagcactttcttatatggtcccatgggtttgtcaacagctgggacagccttagagagatgttaaataagaaatctcatttactttttctctggtgattgaaatactttatataagtcacattctaccattggctatgcatattgtagaatgcttacctctgacctacttatagcacattttgtatcatagtggatgacgtagtagatgaaagtgatgacaacgatgatattgatgtagaagctgaaaacgaaactgagaatgaagatgacctagatcaaaattttaaggttagtataaatttctgtaattagttagctttataaatgatatactacagttgtaaaacaaaaattgggtaaataaatatatatgtaattttaggttttactttgtccacatctttttaccatgaatgactat

SEQ ID NO: 433661 - DNA, 7239 bp, Homo sapiens
  misc_feature (5909)..(5909): n is a, c, g, or t
  misc_feature (6344)..(6344): n is a, c, g, or t
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagaggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433662 - DNA, 7056 bp, Homo sapiens
  misc_feature (5726)..(5726): n is a, c, g, or t
  misc_feature (6161)..(6161): n is a, c, g, or t
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433663 - DNA, 3931 bp, Homo sapiens
cggggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagaggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgata

SEQ ID NO: 433664 - DNA, 3714 bp, Homo sapiens
  misc_feature (30)..(30): n is a, c, g, or t
  misc_feature (2384)..(2384): n is a, c, g, or t
  misc_feature (2819)..(2819): n is a, c, g, or t
aagtgacgaggtcggcctactgggaggctncagggagcgcgggagcgcacttcgactagcaccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgcattcattttgtcatcttctttaaccagctcagattatttgatgtatagaactttgtgagaatgtgataaaaacccagaattggacacagtgataaaaagttgtttttaagaaatgctgggattacaggcgtgcgccaccgtgcctggctaaatcctttcttgtaatgaaacctacctgggttttagccctcttgctgcaagaatgactttatttttaaataaaataaagcaaatccattgactttggataagtgttttaagaactaagtttctgatataataaaacaacctccaaaagatacctcattgcagattttcgccaggattcaggtgcttaggttttggcacatatcttcctcactttttcctatagtgtttttaacctgttataattggaatgatagagatgtatttcagaattttgcatggtccaaatcaatgatttttctttttaatatgtaaagtatttcattaacagtgtagattctttctgatgtttggggagccatgtttaaaaatgtagtatggagcaattgaaaaaggggtctttttccctagcctaattcttactaatctcagaaaacaaagatcaaatagactgtgaagttgaactagtcctcttagtgtagtaaccaaatttaggaaagatcaggataatttaggaaggaaagtaatcatttatttaattatttataattataaacaattattttatgttttgtatattttatgtataaaacaattacatgttttattatagttatacttcttcagagagtagattatggagccaccatgtccatacagttagttgttccttggtattcttggattgattccaggaccccccacagttacccaaatccacagatgctgaagtctctgatataaaatggagtagtatttgcatttaacctatggacatcctcctgtatgctttaaatcatctctagattacttataatacctaatacaatataaatataaatgctctgtaaatagttttattgtatagtgtgtgtgtgtgttttaagagacgaggactcacaatgggacactttgaccaggctggtctcgaactcctgggcctacacaatcctcccacctcggcgtcgcaagtagctgggactacaggtactcaccactatgcctggcagttttttaaatttgcgtttttaaaaattgtttattatttattgaatattttctacctgagattgacttaatctgtggatatggaacctatagatatggagggctggctgtatatgaatttgtttttggcttttacaaaattagaaattaaaagtaactacagttactataatgtgcagaatgactcaaatatttccatttattatgttagtgtaaaaactcctaactacgtattataatattttatattaatgaagtactttagcatacattatgagcctgaataaagctttttattaaatattcacaagattgaaggagaaattctttatagttaggaaatgattttttcataaacaataaatagctttgaaaatataaaaaaaaatttagggctgggtgcagaggctcatgcctgtantcccagcactctgagaggccgaggcgggtggatcacttgaggtgaggagttcaagatcagcatggccaacatggtgaaactccacctccacgaaaaatacaaaaattagccaggcatggtggcatgcgcctgtaatcctagctacttgggtggctgaggcatgagactcacttgaacctgggaggcagaggttgcagcagtgagccgagatcaagccgctgcactccagctggggcgacaaagcaagactgtctcaaaaaataaaaacaaaaaaattaaaataaaatcctaactttcctagttagaaatataattaacttttattggctattagtagctaaaattgcccttatttttgcttctgtggcctcattttttttctcggttattcagtatttaaattatggcttagatgtcttcaatgctatagtcctnaaaattaatgatctacgttgtgcagcagtgatgggatctgataaactgagtctgatgatggagtttagatttatttcctttaccttgcatttggaactttgaatctcttaaatgtggttttggtctagtccactggttctcacgttgtaatgtgcatcagaatcttctgaagacacagattgctgattatgtagacctggggtggaggtccaagaatgtgcattccttgcaaattcccaggtggtgatgctgcagagccacactttgagaatcactagtataatccagtatgctcttccagcatcacaccttccttcctgagaatcacaggagttgtgaactgcagattagcattggggagaatttagatcaaactaatttgtagaatcaaggaggtcaagtaaggtcacaggggcacttgggttgagccagggttttagcccaggtcttctgacaactgcctcatgtccttaccacaaaggagctgctatcctttgcctttccccaaagagtgaagactgcttaaagctcaaggatctttcttgaatttgtgaaatttgttcaggcaaggtgaaaagcaaaaacctatggttcacattgactttttgtattgatcattgtcttttgaagacaggaagtatgatcagtctctgccacttgtgctagtttttgtgtggtgtttagaaacatgggcatttgtctggatcctaattacaaataagtaacctagaattctcttcagatagtgcactaacagcaatgaatctattctaaatttcaaatatccaaattaaaatgactgtattagcataagtactgaaatggataatacaataaatgtattaatggaattgtttttgtgcatgatacagaaataaatgatagtaacgaaact

SEQ ID NO: 433665 - DNA, 821 bp, Homo sapiens
ggcgtggccttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccagggggagaactccgtcctgcatctgcccgaagcccctcccgccgcgcccgccccgccgccccccaagccag

SEQ ID NO: 433666 - DNA, 770 bp, Homo sapiens
ggcgtggccttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccaggtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccagggggagaactccgtcctgcatctgcccgaagcccctcccgccgcgcccgccccgccgccccccaagccag

SEQ ID NO: 433667 - DNA, 887 bp, Homo sapiens
ggcgtggccttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttcattgcgtgatctcctgtgtgtgcccgagattgtgatggctggctgtgcatgccgccctgtgtctcctgcagtatgctgggcactgatgtgtggtggcccctgcgtccgcctgatagctgcttgtggctgcccttctcactttaccttgtgcagcgttttccttgctaacttctggcgggctgcccacgcgggccctgcctggcccactgctgccctgtggacaaccactgtctcctggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccagggggagaactccgtcctgcatctgcccgaagcccctcccgccgcgcccgccccgccgccccccaagccag

SEQ ID NO: 433668 - DNA, 927 bp, Homo sapiens
agattgcaccattacactccagcctaggcaacaagagcaagatgctgtctcaaaaaataaaaataaaaagctgtaagattttataacttcatgaggcagatccttcagctctgccggcatttgggccttaacctgaaatcagtactaagaagtcaagatcaggagaaaggagtatcttaattatgggcatttctttggtatagtcttggattctttattcctaggtagatttcgggcagacaacttgaacaagctgaagaacctatgcagcaagacaatcggagagaaaatgaaggtaagagaactgaataacaaacagccatgagaacttgagcggagatatttgatcttgctcttagctaatgttcacagaagttctaactcagtgtttaagtctacaagatgttcaatttcttaccaaaggggaaaatattattttaaaaagatagggaggcagggaacttggaggcattttcatatactttaccacaagtccatcttctgtgttcaggtaagattctttgttgtctagctgtttgttgtctattctgttcttatattagaaatataaattccaccagtcatcttttttatggcagatttcagatttgtcgtctcagcgtagttatgctccataatgaaaactacagattcagagttcaaatcttgctacgttatgtgtcttttaggcaagttaatgcctcagcctcagttttctcatttataaaatgacaatactaacactcacctacagaatggaattgttagaacttttttttttttaatttaaacgccaagcaatggttatggatagaactaaatttcttttaaatgtagaaaatttggcacagtgtctagaacatgtagttgttcagcaattgtgagttataatgaatggcaagtaatgttactggccttcatccaaaa

SEQ ID NO: 433669 - DNA, 932 bp, Homo sapiens
  misc_feature (26)..(26): n is a, c, g, or t
  misc_feature (31)..(31): n is a, c, g, or t
  misc_feature (51)..(51): n is a, c, g, or t
gagacaaacaacacaaataatcggcnaggtngaggccggtgttaatcggcngaggcgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgatcaaaggcttctcctgagactgcgtcacttctgcaacacagtagattcattccttcggtatcggaagcatttcggggcgttggaggccgctcttggccaaaataaatgaccctgaagcttttcggaaggccatcccccgacctatgggcatacctttaagaattagaaaagtcttttccgtggtagatcaaacgcgaggggagtgaggaggcgagcaaaagattgtaatgactgaagctgtttaattgtgatttgtggacgttttcctttaaagacattggcagagttgggctagaacctggaactgccggatcttggagtcatatcgggcatctatcatgaagccgaataaaaccatagaaccatctgcccataaatctctgcctgtattaactggagtggtcgctggttgggcggatgctgtcaagtacttgtgatttgatttgtctgatgcaataggtctgcaaccatctgggagctaggtcgatgacagtacactgcaaaggcagccactatccaagagtgtgatggatttctattaggaaaattgattttctcctgtttataaggatcttggatgtcaacagaatattgtgactgggtgggggggaacaggtgagagcctatggagaagtgggggggaaacatggttatgtgttgtgatggtattgctattgtgaaaaaga

SEQ ID NO: 433670 - DNA, 722 bp, Homo sapiens
ggcgggtcagcgcgccggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggtaagagctgggaaccagtgaggataggattatgaa

SEQ ID NO: 433671 - DNA, 722 bp, Homo sapiens
gtgtaatttcagtcacgggacggcgctttgtcttacataactggtccgtcggcgacaatagaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagctcgccgggcgtcctgctgtccttgcccgctctcctcatatccttcgccttggcgtccgcgcc

SEQ ID NO: 433672 - DNA, 2158 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433673 - DNA, 2283 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctgggggagcaaaaaaaaaaaaaaaaaaaaaaaaaacaatgtggtgcggcagcgactaagcgccccctcaagaagaggtttgaaacacccgcgaggggccagcgaggcacaagaaggagcaaggcaacaatgggcaataaggtcaccacagagaaaaacggggcacgaaacaacgcggacgggatcccacccattaaagc

SEQ ID NO: 433674 - DNA, 2182 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctgggggaacttttcgcgtttttaaacccaacaattggtggaaactacttcggtctcaagcgttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433675 - DNA, 2855 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaagggtagatggcccccagggaggtgggaagcagagtcttcagtacacggcccgtccgaattatttctcagcctttggggtgcactggtccccagcatcatgggaaaatctgagcttctcaatctagaccaaaaagggaatctgaaaatgccttctactgagtcaggactgagttcttttagctagaaacctgaatctagctctcttctataaggtaattctagcttttctctttctggctttgtttttcttaactccagagaaagaataatctccatttatctacacagaacaagttggaggcttccctcttctcacccaagaaggtctgggttgtaagctgctctcttcaaacccaattttcaggccctactcttttccaagtcaggagcttgaaaggggtgaaaaggaaaggccacaatagtagtttcttccttccctcaaagggcccaactcctcagaataccagaagctaccacttgtcactcatcgaaacatgagggatctttctgcagttatctaataggcaataaataccaaataattcaaatttagaaaaaagttgctaaggggtagaacccatcattttgatttggacagttgtggttggggaagtctggttgaatggatggttcctggccgtcagtaagacccgatgagagttgagcccgacttcccctctgggaccctgtcttcccaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433676 - DNA, 1905 bp, Homo sapiens
  misc_feature (26)..(26): n is a, c, g, or t
  misc_feature (31)..(31): n is a, c, g, or t
  misc_feature (51)..(51): n is a, c, g, or t
gagacaaacaacacaaataatcggcnaggtngaggccggtgttaatcggcngaggcaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433677 - DNA, 2224 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaagagaaagaataatctccatttatctacacagaacaagttggaggcttccctcttctcacccaagaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433678 - DNA, 2262 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagaagttaaaggtgtaggtagtaagggtgcagtgttctaagatgaggaacaatggtagcttggaatagtataacagttttagaagtttcaatagcatgggggttggaagctgtctgtggcccacttgggcacccacgcttctgtccacttctggttgccaggagacagcaagcaaagccagcaggacatgaagttgctattgaaacttctaaaactaggcatagcacctattatatatgaataaacttaaatgaaagggttttagtatctaaaggcctcaaataatttagtgacagaaatagtgctagtgcacttctaaaacccagggggaccctatagaccctaccttacctgac

SEQ ID NO: 433679 - DNA, 2309 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattccagggagctttatgaataaaacacttcaataaggtcttcaaataagactgccaagctttgctacctcatcatgatgtctaaaaagcaccccatttgggaacatttcattcataaagctccctggaccatggcagctctcggtgcctactcactgggtgcagcacaactctcagggcaagaagggactgccttcctgccgcatgcctgaccggcaactgaagcctccccatggggcaaggctcgggacctgcagcccaccatgccggagcctcccccaaatgccgtgggctccagcacagcccaagcctcccacaacgagcaccgccccctgctccgcggcgcccaatcccattgactacccaagggctcaggagtgcgggcgcacagcgcgggactggcagcagctccgcctgcggccccggtgcggataataggtgaagac

SEQ ID NO: 433680 - DNA, 2106 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattagcctgggtcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433681 - DNA, 1847 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgccaaggacctggatccccctttgtgaaggcctgggcgcccattgggggcgggggaccatccaaggaggcggaggaggcacacattgggggccggcaaaagggagcgcggcgaccgggacgcgacaccctgagaacacag

SEQ ID NO: 433682 - DNA, 1774 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactaatccccggtggaccagtcattgggagatgtttgaagagatgattaccacctgcagat

SEQ ID NO: 433683 - DNA, 2179 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgattcttggattctttattcctaggtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433684 - DNA, 2275 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatagtctcattctgttaccaggctggaatgcagtggcgtgacctcagctcactgcaacctccacctcccaggttcaagcgattctcctgcctcagcctcctgagtagctgggactacaggtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433685 - DNA, 2171 bp, Homo sapiens
  misc_feature (1519)..(1519): n is a, c, g, or t
  misc_feature (1525)..(1525): n is a, c, g, or t
  misc_feature (1530)..(1530): n is a, c, g, or t
  misc_feature (1537)..(1537): n is a, c, g, or t
  misc_feature (1555)..(1555): n is a, c, g, or t
  misc_feature (1560)..(1560): n is a, c, g, or t
  misc_feature (1563)..(1563): n is a, c, g, or t
  misc_feature (1573)..(1573): n is a, c, g, or t
  misc_feature (1577)..(1577): n is a, c, g, or t
  misc_feature (1579)..(1579): n is a, c, g, or t
  misc_feature (1582)..(1582): n is a, c, g, or t
  misc_feature (1594)..(1594): n is a, c, g, or t
  misc_feature (1599)..(1599): n is a, c, g, or t
  misc_feature (1608)..(1608): n is a, c, g, or t
  misc_feature (1628)..(1629): n is a, c, g, or t
  misc_feature (1638)..(1638): n is a, c, g, or t
  misc_feature (1647)..(1647): n is a, c, g, or t
  misc_feature (1653)..(1653): n is a, c, g, or t
  misc_feature (1667)..(1667): n is a, c, g, or t
  misc_feature (1673)..(1673): n is a, c, g, or t
  misc_feature (1679)..(1679): n is a, c, g, or t
  misc_feature (1683)..(1683): n is a, c, g, or t
  misc_feature (1691)..(1691): n is a, c, g, or t
  misc_feature (1694)..(1694): n is a, c, g, or t
  misc_feature (1728)..(1728): n is a, c, g, or t
  misc_feature (1749)..(1749): n is a, c, g, or t
  misc_feature (1755)..(1755): n is a, c, g, or t
  misc_feature (1763)..(1763): n is a, c, g, or t
  misc_feature (1769)..(1769): n is a, c, g, or t
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcagtctttgaatcatgctgccagtaagaagcttgacaaaaagaatgataacaaaaaaaggaacaaacaataaaaaaaaaacataaaaaaaaaaaacagattaaaaanatacancgaanaaaaaanaaatatggaaaaaaaaanaaaanaangaaaaagganaagnanaanaataaaataaangctanaataaacanaaaaaccaagtaccatactnngccaaactnaaaaaatanaaaaanaaaaaagagaaaanaataancatganaaanaaaaaganaancaaacacaaaaaaaaaaaaaaaaaaaaaaccaantaaaaaaacaagcaacccaanaaaaanaaacaaanaaaaanaaaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433686 - DNA, 2180 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctggcctggcctgttcatctgcagaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433687 - DNA, 1473 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggtatgggacccagcctcttctcagcctccctttcctgtaatcccagacgccaccctta

SEQ ID NO: 433688 - DNA, 1659 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagacggtcgcatagtgctgacgattcaggtggctttgctgagtgagtacctgccacctgcacacagtaagcctgtgttatctaactttattccaactaccaccctagctggctgtgtccattcggcatcatttcctgtcacacagagtcacactggtcacccacttccatcatcttagttgctggcagcagtgctccatacccacccccaagtcagccctccatctgttttcctgtaagtcaggcctggtaggctggttcctgcatctctgaggaatgatgcggccgtctggtcg

SEQ ID NO: 433689 - DNA, 2097 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctgtaagttatagttcttttagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433690 - DNA, 1847 bp, Homo sapiens
  misc_feature (416)..(416): n is a, c, g, or t
  misc_feature (424)..(426): n is a, c, g, or t
gaaaaggcatgatgtcccaaatcaaggacagagaggagacacatttgtttctcaacagccaactgaattacaactttaaaacattcttacagatgtcagataagaccttgtcttgggctgaccaatatcatcttatattatcaaaatgcttatagtcagctgtcaccagtgcctggattggtttcacatacttttatagacacagttagaaactttctgataacattttagtaaactcttgagtaactttggagagagaatcatcatgcttcaattcattatatgcagatcaataaagagaagtaggaatagcacaaaatatagtcctagtatagtctaccctgctgttaagtaaagctgctttctttttttcattgcccaaatgtatggcttgcatccaactagtcactgatggnagcaagannncatcttctcccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433691 - DNA, 1535 bp, Homo sapiens
  misc_feature (104)..(104): n is a, c, g, or t
  misc_feature (112)..(114): n is a, c, g, or t
cgtcctatcagcaaaaggtgtgcggctttataagcgggcgctacgccacctcgagtcgtggtgcgtcagagagacaaataccgatactttgcttgtctgatggnagcaagannncatcttctcccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433692 - DNA, 2014 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433693 - DNA, 1858 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433694 - DNA, 1131 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtgggtgcgcttgccgccgtccggacggcgtcctctcttgcacagggcggtcctggctgttcctggaccaggctctgcatgcccagtactgccccctttccgccagccctctgcggcacacggtccgggggctaccattccccatgcttataccccccctatctctccattggacgcggccacgggacggggtcccctcgcccagcgcccgccggtggcgccctccggccttcaggcccctcgatgccgaccttcat

SEQ ID NO: 433695 - DNA, 1243 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatat

SEQ ID NO: 433696 - DNA, 1155 bp, Homo sapiens
tggcgaattcggcacgagggagagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgcttcatcaatgaggagtcggacttttttgattgtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaaggtaagagaactgaataacaaacagccatgagaacttgagcggagatatttgatcttgctcttagctaatgttcacagaagttctaactcagtgtttaagtctacaagatgttcaatttcttaccaaaggggaaaatattattttaaaaagatagggaggcagggaacttggaggcattttcatatactttaccacaagtccatcttctgtgttcaggtaagattctttgttgtctagctgtttgttgtctattctgttcttatattagaaatataaattccaccagtcatcttttttatggcagatttcagatttgtcgtctcagcgtagttatgctccataatgaaaactacagattcagagttcaaatcttgctacgttatgtgtcttttaggcaagttaatgcctcagcctcagttttctcatttataaaatgacaatactaacactcacctacagaatggaattgttagaacttttttttttttaatttaaacgccaagcaatggttatggatagaactaaatttcttttaaatgtagaaaatttggcacagtgtctagaacatgtagttgttcagcaattgtgagttataatgaatggcaagtaatgttactggccttcatccaaaa

SEQ ID NO: 433697 - DNA, 1063 bp, Homo sapiens
cctaaagtcagtctaactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgagttgttcaacgtcatggacaccccgtgtcgggagtcgtatgagtaccat

SEQ ID NO: 433698 - DNA, 277 bp, Homo sapiens
tggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatctatcgcaataccatatttaaacgttctggggtttcctacagagaccagtatgaccatgac

SEQ ID NO: 433699 - DNA, 1828 bp, Homo sapiens
cctaaagtcagtctaactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggcta

SEQ ID NO: 433700 - DNA, 1786 bp, Homo sapiens
cctaaagtcagtctaactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggcta

SEQ ID NO: 433701 - DNA, 1677 bp, Homo sapiens
cctaaagtcagtctaactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcatgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggcta

SEQ ID NO: 433702 - DNA, 885 bp, Homo sapiens
tggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggcta

SEQ ID NO: 433703 - DNA, 780 bp, Homo sapiens
  misc_feature (5)..(5): n is a, c, g, or t
  misc_feature (29)..(29): n is a, c, g, or t
  misc_feature (37)..(37): n is a, c, g, or t
  misc_feature (46)..(46): n is a, c, g, or t
aggcnggggttggtggagacagtgaggcngggacacnaaattgccnagtcaggacatctgcacagaattctattcctcatcctttttttttggagagggagtctcactgtgtcaagagtccagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggcta

SEQ ID NO: 433704 - DNA, 319 bp, Homo sapiens
gcgtgagccaccgcgcccggccttgacttcttaactagctacttacattgtccagtaactatatgaagttattaattcaaaaatttattttgcctgcatgatttctgttaactgtttcaagcaggctgcctaagggtctttaccttgctttgcggtttttgccgatgtgggtgtttcctctgggttctttcctgtttgtatgtctttccttttcggttaattcacattttgggtgggggtgggtagatgggaagaggactagttgactgtttcgcaagttgaatagaatactgaaaaacgcaagcatcagagaatattt

SEQ ID NO: 433705 - DNA, 682 bp, Homo sapiens
ggctgccagggcagcgtgggacgctacggcggatatggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcagggggaagccaacaccatgtatgaagtttaaccaccctgagatggccacgtcctgaagaagcccagtctagccatgcggagagactacatgcataagaggtaccccactaagcctctagatgctccaaccatcccagccgaggtaccagacaaatgaatgaagaaatcttcag

SEQ ID NO: 433706 - DNA, 1991 bp, Homo sapiens
ggctgccagggcagcgtgggacgctacggcggatatggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcaggttggtaaattcattaatttattcattgatctaattaaaatatactaagtgcccctcacctgtgctaggccaatgtgatacaatgagcagaacagtcatgggccctccctgggaagccctcactagcccaaggactccttgtagacatttaagtgtccacaggctctggagttccaaccttgagtgcaatttagcagctgtggaccttgggcaagtcattacatctaagcctgttttctcttctgcaaaatggttaaggattcaataagataaaactgtaggcaatgaaaaccgtacctggtaacagtaggtgctgaagaagtgttagctattaatttttgcttaatttttctctctctgctctatgtgatgaaaagattcaagaggcaattgttggaatgtaaaaagagcacgggacttggagtcaaatacttaagtctaccatcaagtagttgttaagaattaaacaacaatttttgtgtacccagttaaatgtgggctgcttaggaatgatgactgtgtcttaatgatctctgtattcttagtgacatgtagaatcattgtgcctgacacatagtatgtactcaggaaagaaatggaaaatgtggttttagcattgaaggccgggagagagggtctaacagactacaagccctgccaggagcagagtaagggaaacagaggagaaaagtgtttttagtctgtgcctgaatgtatttacatctgtttgtagcccaaaagccaaaagcatacatacgcttggcttttctgtagctatgtttatggctttacagcagattttatggagctgcaattactttgatcatgagggactgatgctagtggatttacttcaccgagtagttaagagtgcaggctctgatttagtgatcagagtctgcattgtcaggaatgggacaaagtgaagttatgtggcacttgataggatgccctgagaagattgcaacatcacccctgtgatattcctgctgaagatccataacctggatgtaatcatgaggatatatcagacaaacccacgtaaagagacatgctgtatacaaaactgtaatcttagaaagtgccaaggtcatgaaaatcaaagatagaccctggaactgttccaaactggaggggaccaaagaggcatgacaactaaacacaacacatgattctgaactggatctttttgcttgaaaggaagttacagggacagttggaaaagtttaaatggggcctacaatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatccaaa

SEQ ID NO: 433707 - DNA, 1614 bp, Homo sapiens
ggctgccagggcagcgtgggacgctacggcggatatggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcagattcaagaggcaattgttggaatgtaaaaagagcacgggacttggagtcaaatacttaagtctaccatcaagtagttgttaagaattaaacaacaatttttgtgtacccagttaaatgtgggctgcttaggaatgatgactgtgtcttaatgatctctgtattcttagtgacatgtagaatcattgtgcctgacacatagtatgtactcaggaaagaaatggaaaatgtggttttagcattgaaggccgggagagagggtctaacagactacaagccctgccaggagcagagtaagggaaacagaggagaaaagtgtttttagtctgtgcctgaatgtatttacatctgtttgtagcccaaaagccaaaagcatacatacgcttggcttttctgtagctatgtttatggctttacagcagattttatggagctgcaattactttgatcatgagggactgatgctagtggatttacttcaccgagtagttaagagtgcaggctctgatttagtgatcagagtctgcattgtcaggaatgggacaaagtgaagttatgtggcacttgataggatgccctgagaagattgcaacatcacccctgtgatattcctgctgaagatccataacctggatgtaatcatgaggatatatcagacaaacccacgtaaagagacatgctgtatacaaaactgtaatcttagaaagtgccaaggtcatgaaaatcaaagatagaccctggaactgttccaaactggaggggaccaaagaggcatgacaactaaacacaacacatgattctgaactggatctttttgcttgaaaggaagttacagggacagttggaaaagtttaaatggggcctacaatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatccaaa

SEQ ID NO: 433708 - DNA, 167 bp, Homo sapiens
aatggaactcactttgtggcttctgaagaagggacctttgtggactgtcatggagtagttaagagtgcaggctctgatttagtgatcagagtctgcattgtcaggaatgggacaaagtgaagttatgtggcacttgataggatgccctgagaagattgcaacatcac

SEQ ID NO: 433709 - DNA, 2681 bp, Homo sapiens
tgtttaggggaggtgctgggatgctccacatggctggagagacgaagtagttaaaaattattactagggagggggccggaacctcgggacgtgggtatataagacggtgcctgagcgcagagcggctgctgctgctgtgatccaggaccaggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatgaaaaaaaa

SEQ ID NO: 433710 - DNA, 1780 bp, Homo sapiens
tgtttaggggaggtgctgggatgctccacatggctggagagacgaagtagttaaaaattattactagggagggggccggaacctcgggacgtgggtatataagacggtgcctgagcgcagagcggctgctgctgctgtgatccaggaccaggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaat

SEQ ID NO: 433711 - DNA, 2428 bp, Homo sapiens
ctgtggtgtttttcccccgctcctctggctgccttcctgatggatctctgtggtcccaggcaggaatggcctgcttggggacccagcgagctcccaaggcctttcctgctgcttcctctatccctgtgttttgcttggctctctaaattgactcagctccaggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataataactcattgacttggttccagaattttgtaattctggatctgtataaggaatggcatcagaacaatagcttggaatggcttgaaatcacaaaggatctgcaagatgaactgtaagctcccccttgaggcaaatattaaagtaatttttatatgtctattatttcatttaaagaatatgctgtgctaataatggagtgagacatgcttattttgctaaaggatgcacccaaacttcaaacttcaagcaaatgaaatggacaatgcagataaagttgttatcaacacgtcgggagtatgtgtgttagaagcaattccttttatttctttcacctttcataagttgttatctagtcaatgtaatgtatattgtattgaaatttacagtgtgcaaaagtattttacctttgcataagtgtttgataaaaatgaactgttctaatatttatttttatggcatctcatttttcaatacatgctcttttgattaaagaaacttattactgttgtcaactgaattcacacacacacaaatatagtaccatagaaaaagtttgttttctcgaaataattcatctttcagcttctctgcttttggtcaatgtctaggaaatctcttcagaaataagaagctatttcattaagtgtgatataaacctcctcaaacattttacttagaggcaaggattgtctaatttcaattgtgcaagacatgtgccttataattatttttagcttaaaattaaacagattttgtaataatgtaactttgttaataggtgcataaacactaatgcagtcaatttgaacaaaagaagtgacatacacaatataaatcatatgtcttcacacgttgcctatataatgagaagcagctctctgagggttctgaaatcaatgtggtccctctcttgcccactaaacaaagatggttgttcggggtttgggattgacactggaggcagatagttgcaaagttagtctaaggtttccctagctgtatttagcctctgactatattagtatacaaagaggtcatgtggttgagaccaggtgaatagtcactatcagtgtggagacaagcacagcacacagacattttaggaaggaaaggaactacgaaatcgtgtgaaaatgggttggaacccatcagtgatcgcatattcattgatgagggtttgcttgagatagaaaatggtggctcctttctgtcttatctcctagtttcttcaatgcttacgccttgttcttctcaagagaaagttgtaactctctggtcttcatatgtccctgtgctccttttaaccaaataaagagttcttgtttctgaagaatgaaaaaaaa

SEQ ID NO: 433712 - DNA, 2098 bp, Homo sapiens
ccctgccccgccccgcccccttcttccggaggagctgcggtgggggcgctccaccgggtcctaggaaaggggctctctctggccccgtccccggcggccccgctcccggccccccggcgccgctcagcctcccgcccagcccctccgcgcgtgacctcggccccgcccccgcgagcccctgccccgcccccgctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433713 - DNA, 490 bp, Homo sapiens
  misc_feature (7)..(7): n is a, c, g, or t
aaaaaanccggggaaagtcttgggaaaatttggaaggaaggtttattgaaggaagcttgaggggcccttgagggccattgggttcaaagaaaggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaa

SEQ ID NO: 433714 - DNA, 282 bp, Homo sapiens
tggcgaccgtcacataggaacagctttatcgcctttataagcgcgatcgctcctggactgttccatagaaaggtgaggccgcccgtccctcggctcacttggccctttctccagcaagcgggccatgcagttgtgaccagggcgaggcctgtgaatggaacatgacctagtatggtttgtgggcagtgagctggacagatgccagcttgcccttgtaccagccagctgttgggctgtgccagtcagggggcaagtggggatgagacagagggtgagcagggg
